United States Patent 9,677,139 (GENETIC MARKERS INDICATIVE OF A CANCER PATIENT RESPONSE TO TRASTUZUMAB (HERCEPTIN)) - sequence listing, part 3

SEQ ID NO: 1 - DNA, 15429001 bp, Homo sapiens (residues 4,408,287-6,612,429 of 15,429,001)
tgaatcacttagtccagagtctgacatataataaatatacccaaatgcaaataattatggttgtcaaagtacatttttaggtaagagccaaagtgtttaggtaaggaaatgaaatcaaatacaggttttcctgagtctacgtatttaataaataagagtagtcaatatgtagattaatagatacatatttagcatcctgttattactgaagttatgcattttaaaaccaattaattgacacactcattctttaataaattaccaagggaaaataatacaggtctatgatatcaactaaaaggaaaaaattataatcatttctgcttaccatgaggcttacataaaacatcttataacaggttattttaagctgataacaacttaacattgattacataaaataacactacacttttactccccacacacacatttcatgtgggttttgtttttaaattttatttcagtagttttggggaacaggtggtgtctggttggatggaaaagttcttctgtgtgatttctgagattttggtgcatccatcacccaagcagtacacactttacccaatgtgcagtcttttattcctcacctccctcccacccttccccccaagtccccaaagtccattatatcattcttatgcctttatgtcctcatagcttagcttctgcatataagtgaaaacagacgatgtttggttttccattcctgagttacttcacttagaataatggtctccaactccattcaagttgctgcaaatgccattgtttaattccttttcatggcagagtagtattccatggcgtgtgtgtgtgtgtgtgtgtatgtgtgtgtgtcacagtttcttcatccactcagtcaatgagcatttaggcaggtttcattttttgcaattacaaattgtgcggctataaacatgcatgtacaagtgccttttttatataatgacttctattcctctaggtagatacctattcgtgggattgctggatcaaatgatagttctatttttagtttttggggaatttccatactgttttccatagtagtttttactagtttgcattcccactagcagtgtaaaagtgttcccttttcaccacatccatgccaacatctatttgttttttaatttattgattatggccattcttgcaggagtaaggtggtgtctcattgtggttttgatttgaatttccctgataattagtgatgttgagcattgtttcataggtttcttcgccatttgtgtatcttcttttgagcattgtctattcatgtcctttgcccactttctgatgggattttttgttttttattttgttttttgtttttgtttttgttttgctgatttttgagttccttgtagattctggatattacttatttgtcagatgcatagtttgtgaagatttcctcccactctgcgggttgtctgtttaccttgctgattattacttttgttatgcagaagctttttagtttaattaggtcccatgtatttatctttgtttttgttgaatttgcttttgggttcttggtcatgaactctttgcctaagccaatgtctagaagagtttttctgaggttatcttctagaattgttatggtttcagatattatatttaagtctttcatctttcttgtgttgatttttgtataaggtgagagatgaggatccagctttgttcttctacatgtggttggcaaattatgccagcaccttttgttgaaaagggtatcctttccctacttcatgtttttgtttgctttgtcaaagatcagttggctataattatctggctttatttctgggttctctattctgttccattagtctgagtacctatttttataccagtaccaaactatagtatagccttgtagtatagtttgaagttaagcaatgtgatgcctccagatttttttttttttttttgcttagtctttgatatggtttggctgtgtccccacccaaatctcatcttgaattgtagctcctataattcccacgtgttgtggtggggactggtgggagataatagaatcatggcggtggtttcccccatactgttcttgtggcagtgaataagtctcatgagatctgatggcttataaggggaaaccactttcacttggctctcatttatctcgtctgccagcatgtaagacatgtctttcaccttccaccatgaatgtgaggcctccccagccacgtggaactgtgagttcattaaacctctttttgtttataaattaccctgtctaggatatgtctttataagcaacataaaaatggactaatacagtcttgctttgcctatgcatgctcgttttttggttccacataaatgttaggattgctttttctagttctgtgaagaatgatgatggtattttgatgggaattgcattgaatttgtagattgcttttggtagtatggtcattttcacaatatttattctacccaccataaatatgggatgtgtttccatttgtttgtgttctctatgatttcatttggcagtgttttatggttttcttcatacggacctttcacctccttggttgggtatattcctaagtttattttattttattttattttattttaattttatttgtagctgttgtaaaaggggttgagttcttgattgtttctcagcttggtcactattggtgtatagcagtgctactgatttgtgtatattgattttgtacctgaaactttactgaattcatgtatcagaagtaggagctctttggatgagtcttagagttttctaggtattgatcatatcactgatgaacagcaacagttggattttctctttactgatttggatgccctttatttctttcttgtcagggaatctgccccaatattcacataggttcttttctattttccttaagcgtcggccagcttgagaaataaagggacagagtacaaaagagagaaattttaaagctgggcatccgggggagacatcacaggttggtaggttccgtgatgcctcacaagccgcaaaaaccagcaagtttttattagggattttcaaaaggggaggaagtgtgtgaataggtatgggtcacagacatcaagtactttacaaggtaatagaatatcacgaggcaagtggaggcagggcgagatcacaggaccacaggactggggcgaaattaaaattgctaatgaagtttcgggcaccattgtcattgataacatcttatcaggagacagggttttgagagcaactggtctgaccaaaattattaggcgggaattttctcttcctaataagcctgggagcgctatgggagtctggggtctatttcacccctgcagtctcgaccataagagacaggcacacctgggggggccgtttatagacctatacctccaggcatgtattctctttcccagggatgttccttgctgagaaaaagaattcagtgatatttctcccatttgcttttgaaagaagagaaatatggctctgttccgcctagctcaccagcagtcagagtttaaggttatctctcttattcccttaacaattgctgttatcctgttcttttttcaaggtgcccagatttcatgttgctcaaacacacatgctgtacaatttgtgcagttaatgcaattatcacatggtcctgaggtgacatacatcctcctcagctgataggattaagagattaaagtaaagacaggcataggaaatcacaagcgtattgattggggaagtgataagtgtccatgaaatcttcacagtttatgtttagagattgcaataaagacaggcataagaaattataaaagtattaatttggggaactaataaatgtccatgaaatcttcacaatccatgttcttctgccatggcttcagccggtccctctgtttggggtctctgacttcccgcaacactttctcttgcctgattgctctggctgggacttccagtactaagttgaatagaagagatgaaagtggacatccttgtcttgttccagttctcagaaggaatgcttttaacttttccccagtcagtataatgttggctgtgggtctgtcactaatggcttttattaccttgaagtatgtcctttctatttcaattttgctgaaggttttagtcataaagtgatgttggattttgtcaaatgctttttctgcatctattgagataaccatatagtttttgtttttaattctgtttatgtgtcacatttattgacttgcatatattaaactatccctggtttaacatatggtggattatctttttgatatgctgttagatttggttaggtattttgttgaggatttttgcatctatgctcatcagggatattggtttgtggttttcattttttgttatgtcttttcttgattttggtattaaggtgatactggcttcagcctctttctctatcttttgcaatagtttcaggaagattggtaccaattcttctgtgaatgtctgaaataattcagctgttaatccatctggtcctcgacttctttgttggcaattattaaattactgttttaaccttgttacttgtttttggtctgttcagagtttctatttcttcctgacttaatctaagaaggttgtgtatttccagtaatttatccatcttctctagattttctagtttgtgtgaacaaaggtgttcatggtagccttgaatgatcttttgtatttctgtggttttggttgtaatatctcccatttcatttctaattgagcttatttgggccttctttcttctttttttggtctattaatttggtttatcaatttggtttatcttttcaaagaaccagctttttgtttaatttatcttttgtattttttgtttcaatttcatttagtcctgctctgatctttgttatttcttttcttctgctgggtttgggtttggtttgttcttgtttctctagctccttgagatgtgaccttagattgtctatttgtgctctttcagactttttgatgtaggcattaaatactatgaactttccttttagcaccacttttgctgtttccaagaggttttgataagttgtgtcactattattgttcaaataatttttaaatttccatcttgatttcattgatgactcaaagatcattcaggagaggattatttaatttccatgtatttatatagttgtgagggttccttttggagttattttccaattttattctactgtggtctgagagggtacctgatataatttcagttttcttaaatttattgagacttgttttgtggcctattatatgttctgtcatagagagtgttccatgtgctgatgagaagaatggatattctacagttgttgggtagaatgttctgtatatacctgttaagttcatttgttctagggtatagtttaagtccattgtttctttactgatgttctgtcttgatgacctgtctagtgctgtcagcggagtattgaagtcccccactattattgtgttgccatctatctcatttgttatatctagtaataattgtttaataaatttcagaccttccatgtcaggtgcatatatatttaggattgtgatattttcctgttggactactccttttatcattatgtaatatctctctttgtcttttttacctgttgttgaattaaagtctgttttgtctgatataagaatagcaactcctgctcacttttggttttcatttgcatgcaatatctttttccacccctttaccttatatttaaatgagtccttatacattagatgagtatcttgaagacaatagataaggtacttggttggtggatttttatccattctgctagtctgtatctttcaagtggagcatttaggccatttacattcaatgatagtattgagatgtgaggtattattttatacatcattctcgttgttggctaaatatcttttttttcattgtgttattgttttataggtcctgtgagatttatgctttaaagaggttctagtttggtgtatttcaaggttttgagttcagaattttttgtagtgctgacttggtagtggcaaattgtctcagcatttgtttttctgaaaaagactttatctgtccttaatttatgaagcttagtttttctggatacaaaattcttggctggcaattattttgtttgaggaagctaaggatagggccccaatcccttgtggcttgtagagtttctgttgaggaatctgctattaatctgataggttttcctttatacgttacctgatgcttttgcctcacagctcttaagattctttcctttgtctttactttagataacctgatgacaatgtgcctgggtgatgatctttttgtgatgaatttcctaggtgttctttgaactttttttatttgaatgtctagctctctagtgaggccagagaagttttcctcaattattccctcaaatatgttttccaaagttttagatttctcttctgcctcaggaacactcattgttcttaggtttgtccatttaacataatccaaaatttcttggaggctttgttcatttttttaaattcttttttctttgtctgtgtctgattgggttaattcaaaagccttgtcttagggctctgaagttctttcttctactggttcgattctattgttgaaattttccagtgtattttgtatttctcaaaatgtgtctttcatttccagaagttgtgattgttttttatttatgatatctatttatctggaacatcttttgtccatatcctgtattgttttctaagtttatttaagttggttttcacctttctctgctatcttgagtagcttaataatcaaccttctgaattctttatctggcaattctgagatttcttcttgctttggattcattgctggggagctaattagtcttttgggagtgctacagaaccttgttatcagagttgctttacagatttctcctcatttgggtagactagttcagtggaaaacctggaactcaagagccgctgttcagatttttttttgtcccatggggtgatcccttaatgtggtgcactcccctttcccctagggatggggcttcctgggagcaagactgcagtgattgttattgttcttctgggtctagccacccagtgtggctaccaggccctgcctggtgctggcaaatgtctgtaaagagtcctgtgctgcgatccatcttcaggtctgtcagcctgaagaggtctgacagccatcttcaggtctgtcagcaggtctgcacctgctctggtggaggtggcaggggagtgaagtagactctgtgaaagttgttggttgtagatatgttttgtgtgctgtctttctaaaatgctggttatgctagaagtgaagttgccacgtggaaagatgcaggaccactggttagccaagatgttgcaggcagtgtaattagctgccattttctctttccttggaggagggttattctgtcatgagttgctataatgtcttaagttgattggcctccagccaggaggtggcacttcagagagagcaccagctgcaatagtagaagggagatataagcttgctctaagttggccaggataagtatttgggtttctcagggtgatgagtgggttcataaagctcccaagagtttatgtcttttgtgataggctaccaggggaggtagagaaataccatcagacaggggcaggtttaggcgggtctgagctcagactctctttgggtggggcttgccttggccactgttggggatggaggggtggctcttaggccaatggggttatgttctagagggaattatggctgcctctgttgccagggaagtagggggaagccaataccaataggtctcgccgagctctcacagagtttatgtgaccagtctcactcctgcagtgccttgctaacagcaccaagtttatctccaggcagcctgcagggagagactcagacctagccccagcctatatgtttccctgctgacaggccatgcccatccctgtctgcccacactgttggctgcatctcctgctttcctttctgccgcttttcctgttcattcccaaattttgctcaagagagtttgtgcccagtctaaattattgcaaagttccattggaagcttcattcaccatgtgactccctccaaaattccaccacctgccttccctgagagcccctgtgagatacagtcagggataatgtctttgggctcaagctggagaataggagtgcctacaagtctcttcccactactgcttctacttttgtatttcatgcctgatttgttccaactctaggtaaggttaaatccgtctcccataatctgtactttcaggttctgcagtggggttgtgtgttcagaggcaggttttcctcctctcacactttgggaactcaatttttcacctgtctcagcagcttgctgcttctttcaaaggatctgtgatttctttcagttttcctggtatgctcctgcagtggttcctgaagcaaaagtctgtggtgtgagtctccacatatcgttctgttcatccacgtgagagctgcatgttagccctgtcttctatctgccatcttccctccattttgtgttttgatgtcacatttacatctttttatattgtgtatcactaacaaattattgcagctattattagttttgtcttttaacctttttaccaaagatgtaaatgatttacataccaccattacggtattagagtattctgaatttgactgtgttcttacatttatcagtgagttttatacttccatatatttttgtgttactaattagcatcattatctttcagcttgaagaactctctttagcatttcttgtaagataagattggtgataataaactccctcaacctttgtctgagaaagtatcttgccttcatttctgagggataacttaggcaggtatagtattcttggtaggtaatttttttcttttaactctttgaatatattattccactctctcctgactgtcaggtttctgctgagaaatccactgctagccttactggaacttccttatgtgttacttacttcttttgctgctaccaggttcctctctttatctttgatttttgacagtttgattacatgtcttagagtagtcttatttgaattgattccagttgaagacttctgatcttcctttaactggatatttatgtctttccttatatttggaaagttttctgcaattattttttaaaataggctttctggaccttggactttctcttctccttaaacacgtataattcaaatatttgttcttttggtgctgtctcataaatcccatgagctttatttcttttttctcctctgactgtgtactttcaaataacttttttttgagttcacatatttttttctttgctcaatcaattctgctgttgatgtttttctattgcattttttatttcattcattgtctttttaagctctgtaatttggtttttaaataattttattctttctgttaaatttttctttttggtcatttatgattttccttattatgttgggttgcttctctgtattttcttgatgtttgctgagctaccttaaaaacaattattttgaattccttgtcaggcagttcataaacctccatttcttaagggtcagttactggagttttattttgttcctttggtggtatcatatttccctgattattcttgaaccctgtggctgtatgttggtgtctgtgcatttgaagagtggtggcttattccagtttttgcaaactggatttttctgggaaagaccttcagtagttagcccatctagagattctgggtaggccacctggcatggtctctgggcaggcttgcttagtgtctgggtcagcaggtgcacagacctatctctcagatccacaagattgagcctgcagcctgtgtccatggggttggcctgtgatatatgcccctgtactggggtaggcctagagcctgagttcataggggtgggtgtgggtccacaggggctgccctggagtctgtgtctgcaggggtggtcctggagcctgagttcatggaggtgggtctgccatggagtctatatctgcaagggtgttcctggagccacagtccataggggccagtctggcactggaatctattggagtgggtccgtatcttgtgccttctggagccttgatcgacaaggaccagcctggagactgaaagtggtgtagtgctaggtcagacatggagcctgggtccaacagggccatcttgaacctaggatcccaggtgctggtctggagcatgggcttgagggggccagcttggaggatgggaatgcaggttctggcctaaagctagttcttcaagactggcctgagtcctgggaccatgggggcttacatgaaacctgagttcagaggggtggtcctggagccttgatccatgggcactggctcagcactgtggtctactgggatgggtctgctggaccccaggtctgttggagtgtgggggcacaggtgctagcctagagagtagggctacagggaacaatctgacactaggcagacctggatcttgaggccaggggtgctaaactggcagtggggaagatgaagtttagggatgcgagggccagttcactgctggaggctattgggaaccaggggccaccagggttagcctcttgttcgtgtgtgcctagaaactgagtctgccaggcaagcctggagcctggggctagaggatctaccctggtgctgggcaggtctggaggctcagctcatggatactagcctagagtctaaagtcatggggactcgcccaacattgggttttactggatctgtcccagggttggggcccaaggcaaaggctgatgctcacattcctctcctttccccacacagagggtacctctctccaagctgtgatgcctggggttgggggaggagtgatgcaggtgatataaaactatctttcctaccttcttggatgcatcttttcttatttctgtgctattcccaggtgctgtaatctctcacctggtttccttagctcttgtgaaaatagtgttatgcatagatagttgtttaaattgatgtttctgtgagggcacaagtgttagaaagtcatattctgtcaccttgttcacatccagatggagaatggatctaaatatttctgtatacaatcctttctgcatagaatactttctgcatagaaaaaaatcatctgtctagtctagtaggttaccaggaggtttttttggctcataaattgataccctttattcaactgtatccatttagcagatccaagctatgacattgagaaaggaatctgtaaagaggtcacagagcaaaatcttagagtccaactaaagtcttgtctgtgaaatttccaccctgacaatgtcatcatgctgtgtacagctctatatcctctccaccagatcttttcccaaacactaatataattaccagaggaagaaatgagcacaggagacatctggagaaactcagaaacctgaaggtgagagactgcttgttacacctcctcctacatgatgtattctagactgaagttttagagtgtctcttacagcaaaagtgttatttaatcaaattaccccttcaccaattcagtttcaaaataactgaatatttaattaattctccagagggatctaaaatatgcagtttctgaattgattagtgagtaaaaattttatgttttttctgtaattctaacctcattgaactcaaactaaatgcccctaaatgctatcaatctaaaggatattcgaatgttagagctgaatattaagaacatctataggaccatgggcttctaatagcacccaccctgttttcacaattaagctgtacctgaagttaaaggagagggaactattcataatgtgtaattttataaaaatatttaattaagcatttgtaaatgctaggtcacagtcaaatttttaaaagctatttcgtgggtatatttaatggttatgctgtggtttgaatgtcccttcaaaagtcatgttgaaacttaatccccaatgtgacattattgagaggtggggcctttaaaaggtggttgaatcatgaggacagacccattaacccatgctctattggtctgtccttgtgattcaaccaccttttaaaggccccacctctctataatgtcacattggggaataagtttataatccccctaattataaagccaccataatgtcacattatggattaatatgttaatgaattaataagctattgtgggtggggaccagtggttttatagaaagagaaagagagacctgaacaaacatgttcagtccttaccatatgtttccccacaccacttcgggactcttcagagtctccaccagcaagaaggctctcaccagatgaagcccctcaacctggggctcctcagcctccagaactgtaagaaataaaagcattttttaaaataaattacccagtttcaggtattctgttataagcaagaaaaaatggactaaggcaaggtacttgcttaattccacatgataaaaattctgcagcagaaaaaaaaataatatgtaggttccacctaactgcaactaagcaattagaaaaacaaatctcttgtagttctaaacacccgagaggggaaaaaaagaaagaaagaaaagggaaaaaaaccaaatgtcttagttaaaatactgtgcagctcaaggctgattacttgtctaactagaatgacaacaaacaaggcatttcaggacaatcttgagaacaattcgtgtatcaaaaaagccaccaatcgggtataaggttctccttattacgagaagttacaaaacaacctctgctttgacagatacccttatggcaatggaaatgacaatgtgagtggcaaagtcgacataagaatatactcagtagcaaaatatgggaaacagtctttatttccttaatcaaaacaggagtggttaaagagagtcacagattataaccagggcaaggagcactaaaaaatgggtcataggtgaggtcacctcgatggaccttcaacatcgaagtggtcagacaatttttcaactcattaaaatttaagcacatcacccatctacttaaataacaacaacaacaacaaaccttcctaaaaattaacattttcatacaaacgtttgaatatgcacgttcttatttgcaatataggactcaccagctctaaaaataaaatcatgacagctcacagtctttcattgtacagtgaacatcctagatttactcacactcaaaactcattcgtcctaaattgtcaaccaccaagaaaattgtgttttgtttaaaaattttcttgaaagataaataaaactaatctggcctggcatttctctgagtcctctaggtttaggggactgggtggaacccagttgaggcagcagtcagtagcatctatacaaaaagtagttccagccagtgaggcaattaattacccagcacagatgaaagcagcataaacaaaagagagagagactctcttaaataaggaatccaagttgttagcaaaagaataaccaaagcaggtatgtcaaatgcaagggccgaaagggagatttcttaaaagggaaatgaaccaggaattatgagcagaagcaggtggtaaagcacaatttaaaactagccaaggtgaattttcacaacataggtgtggtgctgagtgctgtatacagggtaaagatacaaggctggactgggtgatgtaaaaactcattaaataaattgtctgactggtatttgtgagagagtttatatgctgcaaaaatacctagtcattttgtttactctcaaaatgccacttaggaattcaaggtcaggtttaaatttgcacttttcttccctaaagcagatggatgggcaaggtcttcagcaccagtctggaatgcagcttattcagaagccctgctgtcatgcttaaggcagcccattttttaaggggtggccagctgagtaggcatttgtcaagcagagagcagaaacagaacaagatgcatggagggaacattaagcacaaaatcaggccatgtggcaataagcatgccctgctgtgaagcaatctcagcacctgggagaaagtgagtcattgtgaatgcagggagaaaagacacagagcagcagattttgcaaacagtgaccacaaccaccaagcccagactatgttacaaatggactctgaaaaggactgcatcaaacacacacacacacacacacacacacacagcacacacatgcagcgtgcacacacacacacacggggtttaacgctcttgctgtaagcacctctaacatatatcactaacagaaaaggaatgaaagagaaaaaacactttttaataattatgtttaatagtcatattgtcaaagaaattatctctactttaatgctattttctctctttgggtgttctggatttctccaaaagctgaaaaaaatatttttaagtataaatcagctattatcaggaaattagaatgattttcagatgacgattctttcttttttccttcctttctttttttttttttttttttttgagacagggtattgtaatcttggagacagggtattgtaatcttgctatgttgtccaggttggtctccaacttttgggctcaagtgatcctcccacctcagtctcccaagtagctgggattacaggcatgtgccaccatgcctggcttccattccagatttctaagactactagttagacaggtagataataaactctttcattaattcactcatttatttgttcactcaaccattatttatcaagcacccagcctaagacaacactgtacagacctctggagtcacaatggtgagccttacaggtacagtttctgccttatcggagttgacattctggtagaaaagtcagatattaattaaacagtctcatgaatttggaagcatagagtggaggacttggcatagtcccacagatacaagaaaagttttcttgaggaaatgacatttaacctgagctccaaaggatgaggagaagtgttttaggacctgccaatttaggcatgatcccctctcttaggccttgttttgttttgtttccttttgctttttaaatatataatgtgattaaagtatcaaggcaccaagaaagagaccagccaaaagtgcaggcatttgcagtgacatccagcatcttaaaggtgttctgtcactcaggctgcagtgcagtggtgccatctcggctcactgcaacctccccctctcaggtttaagcgattctcccacctcagcctcccgagtagctaggactacaggcacccgccaccacacccgactaattttcgtacttttagtagagacggggttttgccatgttggctaggttggtctcaaactcctgacctcaggtgaactgcccgcctcagcctcccaaagtgctgggattacaggcatgagctattgcatccggccaggttatgtatttatatatgatatcaggaattgggtgagagaatcactattagaccagcataaagttcattaataaataagtgaggagtaaaaggacagtcataaaaactggaaggaagaaaggccaaaaggcacatgcctcaatgaagcacaattttcaacaagactgtggaagctacccaaaaacagcattgaagagcaaggagaaccccaaccctctctctattctcagaggcatatgtggtatgcaaaaatgcacaactatccccaaggcaacctcaaaatctatgcttccatttctccagaccatctgcccttgctcttccaagtctatcctttttactctgtgaaaagtttatggaatgataccatcatttcttttaaattataaacactattgggtatttgaaagatcacatttttggtttagctagctcaaccctaagatagttaaagctgctattataggcctatcagatagtctcagaagcaccaaaaaagtggaatgtttggataacattccacttttttttttttttgagatggagtttcactcttgttgcccatgctggagtgcaatggcatgatctcggctcactgcaacctctgcctcccaggttcaagcgattctcctgtttcagcctcccaagtagctggtattacaggcacgcaccaccacacctggctaattttttgtatttttagtggaaacagggtttcaccatgttagccagactggtctcaaactcctgacctcaggtcatctgcccacctcggcctcccaaagtgctgggattacaggcggagtttaacttttaaagtaagaccttcaaggaatattaatcagggatgcacattcacaatctattcagttggtatatttggattttatactcaatatatctataatagcatactttcacacttctgcatctccacagttacaaggtcttaatcatagtgactcatactgaactcttctttagtaagtgggattaacattcccacatgaactcaagacactaaattattaatagcctcccaaggcttttggtttttactgtaatgcctgtaatgctttcataaaagtttaacagcatttaagtaaaatataggctcaaagtataacagtttttaaagctatttttcctactatgatttcaacattcttcaggataggaaaaaactaacaaaaaaggccactgtaagcttctcatcaggtaaatattaagtgaggtgatgatctttgtaattatttttaaatgttattacatcacactgaagagttttgtttttactatgtagcatttatggctcatcatcatgactttcttgaccatctgtgttggcatgaaaccagtagtagtcaatgaaaagtgaaaaactgagacaactgtgatatggctcccaaaagacgtggttttaatgggttttgtctattaattttcatgacggtaactggggaagacaatactagaaaacattcaggagaaatgctaatcacaaagaggaaatccctttgcaaaatgctgaagaatttatcattaaaaaagcaaggagggctggtcgcagtggctcatgcctgtaatcccagcactttgggaggccaaggtaagatcacttgagcccaggagtttgagaccagcctgggcaacatagcaagactctgtctctattaaaaaaattatttttttaataggtaaggaggaagggagatgaaggaaattagtcacagcaatgttaccttcaagggtgggaattaaaataaaaagggtccaaaaacaaaggaaaatagaccctaagaaggggtttccagaaaagacgtagattacagttgacccttgaataatgaaggagttaggagcactgaccttactcgcagtcaaaagtatatgtataacttttgactcctcccaaatcctagcactcccaaagtgctaggattacaggtgtgagccactgagtctggccacattgacagacttttaatggacttcaggttgtgatagggtgaaaggaaacaatcatcatatttaccaaagaaagtgatcaagagtatatttgtttcaaaaggtttgccattgttagaagaatgacacggagtgagaacattcagataagctgcagagaaaaaaaacaaagaaaataagaattctggatctgcagttcatggaactcacctacaggagaaaggaatagcaaagggtacaaattatataatggaaattagaatatgagatgaaattgaaaggagaacctgaagagtcaaagtaagaaagaagggggagtttacagggaacctagaagtggtgacaccatcatacaatcgtgaagaaagcaaaacttttagaagagaaaagcaaaataaatagcacatacatgtaaacaggtagtaagagaagactacaaagctcaagatacacttttcaaactaattttttcaaaattatagacaatgaaaagacaaagtgtgaagcgactagcatcagggctcctctcagtggtagtattagcttgctaaggctgtcataataaaataacacaaactcagtggcttaaacattctggagggtaggagtctgaaatcaaggaatcagcagggttggttccttctagggctgttcagagaaggatctgttccaggcttctggacttggccatagacgaagatcttctgtgtcccttcacatgacattcttctgtgcatatctgtgtccaaacttctcaattttttttatactttaagttccgggatatatgtgcagaatgtgcaggtttgttacataggtatacacatgccatggtggtttgctgcacccatcaacccatcatctacattaggtatttcttctaatgctatcactcctcttgcctcccacttcccgacaggccctggtgtgtgatgttcccctccctgtgcccatatgttctcattgttcaactcccacttatgaatgagaacatgtggtgtttagttctctattcctgtgctgagaatgatggtttccagcttcatccatgtccctgcaaaggacatgaactcatccttttttatggctacatagtattccatggtgtatatgtgccacattttctttatccagtctatcattgatgggcatttgggttagttccaagtcctttctattgtaaatagcgctgcaataaacatatatgtgtgcatgtgtctttatagtagaataatttctaatcctttgagtatatacctagtaatgggattgctgggtcaaatggtatttctggttctagatccttgaggaatcgccacactgtcttccacaatggttgaactaatttacactcccaccaacagtgtaaaagtgttctgatttctccacatcctctccagcatctgttgtttcctgactttttaatgattgccattctaactgacgtgaaatggtatctcattgtggttataatttgcatttctctaatgaccagtgatgatgagctttttttcatatgtttgttggctgcataaatgtcttcttttgagaagtgtcttttcatatcctttgcccactttttgatggggttagttttttcttgtaatttgtttaagttccttgtagattctggatatcagccctttgtcagatggatagattgcaaaaatgttctcccattctgtaggttgcctgtttactctgatgatagtttcttttgctgtgcagaagctctttagtttaattagatctcatttgtcaattctggcttttgttgccattgcttttggtgtttggtcatgaagtctttgcccatgcctatgccctgaatggtattgcttaggttttcttcaaaggtttttatggttttaggtcttatgttcacatttttaatccatcttgagttaatttttgtataaggtggaaggaaagggtccagtttcagttttttgcatatggctagccagttttcccaacaccatttattaaatagggaatcgtttccccattgcttgtttttctcaaatttgtcaaagatcagatggttgtagatgtgcaatgttatgtctgaggcctctattctgttccatcggtctgtatatctgttttggtaccagtaccatgctgttttggttactgtagccttgtagtatggtttgaagtcaggtagcatgaggcctccagctttgttctttttgccttaggactgtcttggctatacaggctcttttttggttccatgtgaaatttaaagtagttttttctaattctgtgaagaaagccaatggtagcttaatgggtatagcactgaatctataaagtactttgggcagtatggccatttccatgatactgattcttcctatccatgagcatggcatgtttttccatttgtttgtgtcctctcttctttccttgagcagtggtttgtacttctccttgaagaggtccttcacattcctttaagttatattcctaggtattttattctctttgtagtagttgtgaatggaagtttacttatgatttggctctctgtttgtctattattggtgtataggaatgcttgtgatttttgcacattgattttgtatcctgagactttgctgaagttgcttatcagcttaaggagttttgggttgagacaatggggttttctaaatatacaatcatgtcatctgcaaacagagataatttgacttcctgtcttcctatttaaataccctttatttctttctcttgcctgactgccctggccagaacgtccaatactatgttgaataggagtggtgagagagggcatccttgtcttgtgctggttttcaaagggaatgcttccagcttttgcccattcagtatgatattggttgtgggtttgtcctaaatagctcttattattttgagatacattccgacaatacctagtttattgagtgtttttagcacgaacgttgttgaattttatcaaagagcttttctgcgtctattgagataatcatgtggtttttgtcattggttctgtttatgtgatgggttacatttattgatttgcgtttgttgacccagtcttgcattacagggatgaagccaacttcatcacagtggataagctttttaatgtgctgctggattaggtttgccagtattttattgagaatttttacatagatgttcatcagggatattggcctgaaatgttctttttttgttgtgtctctaccaggttttggtatcaggatgatgctggcctcctaaaatgagttagggaggagtccctctttatctattgtttggatagtttcagaaggaatgataccagctcctctttgtacctgtggtagaattcagctatgaatccacctggtcctgggttgttttttttttttttttttttggctggttggtaggctattaatcactgcctcaatttcagaagctgttattgatttattcagggattcagctttttgggagctgaagggggtttagtcttgggagggtgtatgtgtccaggaatttatccatttcttctagattttcttgtttacttgcctaggggtgtttatagtattctctgatggtagtttgtatttctgtgggatcagtggtgatatcccctttatcatttttttattgtgtctatttgattcttctctcttttcttctttattagtgtggctagtggcctctctattttgttaatcttttcaaaaaacagttcctggattcattgactttttgatgggtgtttcgtgtctctatctccttcagttctgctctgatcttagttattttttgtcttctgctagcttttgaatttgtttgctcttgcttctctagttcttttaattgtggtgttaggttgtcaattttagatctttcccactttttcatgtgggcatttagtgctataaatttccctctaaacactgagttagttttgtcccagagattctggtacattgtgtctttgttctcattggtttcaaagaacttatttatttctgccttaatttcattatttaccctgtagtcattcaggagaaggttgttcagtttccatgtagttgtatggttttgactgagtttcttaatcctgagttctaatttgattgcactgtggcctgagagactctttgttatgatttcttttcttttgcatttgctaaggagtgttttacttccaattatgtagtcgattttagaataagtgtgatgtggtgctgagaagaatgtatattctgttgatttggggtggagagttctgtagatgtctattagatctgcttggtccagagctgagttcaagtcctgtatatccttgctaattttctgtctcattgatgtgtctaacattgacagtagggtgtgaaagtctcccactattattgtgtgggggtttcagtctctttgtaggtctctaagaacttgctttatgaatctgggtgctcctgtattgggtgcatatatatttaggatagtcagctcttcttgttgcatttatccctttaccattgtgtaaagcccttctttgtcttttttgatctttgttggtttaaagtctattttatcagagactagaatcgtaacctctactcttttttttgctttccatttgcttggtaaatcttcctccattcctttattttgagcttatgtgtgtctttgcacatgagatgggtcttctgaatacagcacactgatgggtcttgactctttatccaatttggcagtctgtgtcttttaattggggcatttagcctgtttacatttaaggttaatattgttatgtgtgaatttgatcctgtcattatgatgccagctgtttgttttgcccattagttgatgcagtttcttcatagtgtcaatggtctttacattttggtgtatttttgcagtggctggtaccagtttttcctttccatatttagtgattccttcagggcctcttgtaaggcaggcctgttggtgacaaaatccctcagcatttgcttgtctgtaaaggattttatttctccttcatttatgaagcttagtttgactggatatgaaattctgggttgaaaattcttttctttaagaatgttgaatactggcccccactcacttctggcttgtagaatttctgccgagagatccattgttgggcttccctttgtgcacaacccgatctttctctctggctacccttaatattttttccatcatttcaaccttggtgaatctgaaaattatgtgtcttggggttgctcttctcagtctgacccttatcagagctttcctgaatttgaatgttggcttgtcttgctaggttagggaagttctcctggataatttcctgaagggtgttttccaacttggttccattctccctgtcactttcatgtacatcaatcaaacgtaggtttggtcttttcacatagtcccatattccttggaagctttgttcattccttttcattcttttttctctaatcttgtcttcatgctttatttcattaagttgatcttcaatctctgatatcctttcttctgcttgatagatttggctattgatacttgtgtatgattcacgaagttctcatgctctgtttttcagctccatcaggtcattaatgttcttctctaaactggttattctagttagctgttcctgtaaccttttatcaaggttcttagcttccttgcattgggttagaacatgctcctttagctcagaggagttttttattacccaccttctgaagcctacttctatctattcatcaaactcattctctatccagttttgttcccttgctggcaaggagttgtgatcctttgtaggagaagaggcattcttgtttttggaattttcagcctttttgcactggcttttcctcatcttcggggatttacctacttttcgtctttgatgttggcaaccttcagatggggtttttgcagggttatcctttttgttgatgttgatgctatctttctgttcgttttctttctaacagccaggcccctcttctgcaggtctgctggagtttgctaggggtccactccagaacctgtttgcctgggtatcaccagcagaggctgcagagcagcaaagattgctgcctgctccttcctctggaagcttcattccagaggggcacttgccagatgccagccggagccctcctgtatgagatgtctgtcaacccctgctgggaggtgtctccccatcaggaggcacagggatcagggacccacttgagggggcagtctgacccttatcagagcttgaatgctgtgcttggagatctactgctctcttcagggctgacaggcaggaacgtttaagtctgctgaagctgtgccttcccccaggtgctctgtctcagagagatgagagttttatgtataagcccctgactggggctgctacctttctttcagagatgccctgcccagagaggaggaatctagagaggcagtctggctacagcggctttgccacactgtagtgggttctgaccagttcgaatctcccagcagctttgtttacactgtgagggaaaaccacctactaaggcctcagtaatggtggatgccccttcccccaccaagctcgagcatcccacgttgacttcagactgctgtgctggcagcaagaatttcaagccagtggatcttagcttgttgggctccacaggggtgggatctgctgcgcaagacaactcagctccctggcctcagccccctttccaggggagtgaacaattctgccttgctggcgttccaggagccattcaattggaaatgcagaaatcacccaccttctgcgttggtcttgctgggagctacagaccagagctgttcctattcggccaccttgcctgggaatcccccacttttttttttttttttaagacagggtcttgctctgtcacccaggctggagtgcagtggtgccattttggctcactgcaacctctgcctcccaggctcaagcaattctcatgcctcagcctcccaagtagctggaattacaggcatgtgccaccatgtccagctgatttttgcatttttagtagagacagggtttcgttatgttggccaggctggtcttgaactcctggcctcaagtgatccacccacctcggcctcccaaagtgctaggattacacacatttccccttcttataagaatactagtcacagtggattagaggaccaccctattccaggatgacttcatgccaacttaatcaattttatcagcaacaattctcagtccaaataaggtcacattctagggtactggggttagggtttaacatacgaattttaggaggacgtcattcaatccataacagtagtcaacagggttgccagcagaatgccaagcaggagagggatttttatgtaacccagctatcatctgaggtctcctgctccttgaaatttaaatacaatcatactgaacccctatccacacccagtggatattcacgccctccccaatacttcagtggtttccctgggtattatcaaggcaaactcccatttctggttcctgctcccatgtgctctctatcttgctgcaatgacccacgagagcaatatgtgtcttccttccttggtatccaccaaaccaatgaaaaacaagttagggtcctactcattctaaggactcatgagggtaatgcatgttgctaaagatacaaaggccatttgggaaaatgaggtgtgggagatgaggtatgtgtgtgtaggcagcacacagtgagccactaaacctttctgtcatgaagtgtcttgcaggccagtttgccaccaggcttccacgccaaggttgctccttcctgatgcctggcatatcttcaagcaaacctttgtgctgccaaatcaaccctgtgtttcctgtagtcttctgtgaactggagtgaattccctgaagaaaaggagagaggccctgtcccatccccactgggtcacatgtgtcacattggcactggagcagggccacttgtgtgttgcagtgggcctcttgcggttacagccctctcagcttccctttgagcctctgtcttgagactcatccgagggtgggatcctatatgaaagatacaaactgtgtggcctccttcattcctttcctcccttttcccagggtgtagggcaaaatgcctttacctcgcttcatgcagataaacttcttatagcaccatctatgaatctaggcttgtctgcatcccataatatactcaaataggaacttttgtttcatttactcattaagctttctgaaatgggagctttggcaatgaaacacaagaaaattcccatcacaactgaaagaaactgaaaaatgtaagagaaatgatctaagggagtggggatctgttctttcaatgtgtcagaaaagaggaaacatattacaatacatagaaactctcaatggaaagcacaaacccaaagatttttaaagagcaaagtaaacattcccaactgcgagcatattcatcaagcacgtgctagaaaaaacaaaggtaaaataccagagtgagatatcaaaagacaacatctgagagacagttccgtcaacagagtcaaaactgataagggaagaagagaaatcaagcaagattaaagacatctcctacagatattttaagtatacaaggagagactaaagaacggtagtgggcttaggaactagaaatagattgaagtttagccagaggaaaagaaaataaaaaagatctttaaaaggagcactgcacagaactgtttccaaaacaaagcgtagaagggaccaattctcaggaaggtggggtggacactatgatatgctgcccagacccctgcaagcagagaaggaccctttacctcaactcctggaggtgctgggtaccttcagttggtagccccttcagggactgcctcagttggcagaagagccctgctcaaggtcatgtcccttctcaggaaagcccacattcagtcactcttcaattcaaggacctaaaggtctggccactttgacccaactcaggacatctctgaagggccattctagctccagagttcccggtggggttggttaacactgtcgatgggtctgcataacactttgtcttctccatctaccctcttctgcttcctcccctccctttcttatgcattgatatcaaaagcattccttaattactatactgacgactaaacttcatctcagagttttcccttgctttcctgggaaccaagtttgtgaaggaaggtgaaccaccttacataaacaaatgaatttatgcatccctacaagtgagtgatatgaataagatgctaagcagagggaaagctcctgtgtttataacatcactgctttgttcttaaaacttcgaggatggtctgagaaaacttggttttcaatgtcatatgcaggaaaagtcagcattcacaatttaaagaaacaagtatattatcaatatagtgttaaagagagagaggaaaggcagttttcacttgatggtattaccaccatgcaaacttcttttagaaaaattattacggatatataatagttgcacatatttatggagtagatgtgatactttgatacaaacatacaatgtgtaatgatcaaattgggataactgaggtatccatcatttcaaacatttatcatttctttgtgtttggaatgttccaattgctctctttcggttattttgaaatataagataaattattgtcaattatagccatccttttgtgcaaccaaacattatatcgtattccttctatctaactgtatgtatgcattaaccaacccctttttatcccccacctccccactacccttactgactctggtatctatcattctactccctacattcagaagatcaactttttttagccccatatatatgagtgagaatatgcaatatttatctttctgtgcctggcttgtttcacttaacataatgtcatccagttccatccacgttgttgcaaacaaccggatttcattcttttttatggctgaacagatttccattgtgtatatgtaccacactttgtttatccattcttctgttgatgaacacttaggctgattccatgtcttggttattgtgagcagtgctgcaataaacatggaagtgaagattcctcttcagtatactgatttcctttcttttacatatatacaccacagtgagattgcaaggtcatatgggagttctatttttagttttttgaggaacctccatactgttctccatagtggctatactaatttacattcccacccagtgtgtgagggttcccctttctgaacatccttgccagcatccattattgcttgacttttttacaaaagccattttaactgggatgagatgatatctcattgtagttctatttgcatttctctgaagattagtgatgttgggcatttttcttgtacctgtttgccatttgtatgtctgtttgtttgtttgttttgagacagagtctcgctctgtcacccaggctggagcgcagtgacatgatttcagctcactgcaacctctgccttcctggttaaaacggttttcgagcctcagccccccgagtagctgggattacaggcatgcgccaccatgcccggctaatttttgtatcttaagtagagatggggtttcattacattggctaggctggtgtggaactcctgtcctcaagtgatccacctgccttggcctcccaaagtgctgggattacaggcgtgagccaccacacccggcccattttcatgtcttcttttgagaaatgtctattcagatcttttgctcatttttaattagattacttgttcttttgttattgagttgcttgagctccttatatattctcattatcaattccttgtcagatgggtgacaaatttcttgtatgaatcttattgtaaagtcacgtatgcacagtagaaagatgatggacaagacacaatgttgtgccaaaaagaagggaagtatagctgcatagtggttaggagaactaaagaagcaagctagggaagggcatatgttatattatgttatatactaggaggaaatctgaaacaaacgagctgtaggcagccatgttccaggataaggagcaaagatgagaagtaaagggaaaatcctgtggatattcaggtcccgcttttagtttattcttaaaccctgtgaagaaaaaggatctctatcctatgttagcctgagggaaatacaaggctttgtagaagagcctttggtttgaagatcatcttcaagaaagggcaagtaatctataaagagaaagcaagttaagcctaaagaagcaaattctggggccaactttctcttccattgtagttcttactaccattaaaaagtgtgccgtttcaatggcaaattaaaaccagacattcaaagcatgctatagctctatatgaattcataggaaaaggagtcaatgacatagtgtccaatgaaagaagactttaaagcagtatttaatgacctcattaaggtaaaatatcttatttctacatatggatgtatgtacccagttatctctggatagtgggattttcaaggttgtttttgtatacttttacactggttgaattttctacaatatcatagagaacccatataaattttaatattgagtaaataatgaaatcaggcccggcacagtgactcacacctgtaatcttacctctttgggaggccgagatgggaggatcacttgaggccaggagtttgagaccagcctgggcaacatattgagaacccatctctaccaaaaaaaaaaaaagccagtcatggtggtgcatatctgtagtcctagcttcttgggaggctgagggaggaggatcacttgatcccaggagtttgaggctacagtgagctatgatcacgccactgcactccagtctggatgacagagcaaatgcttatctcaaaataatgataataacaataacaaaatcaaataagtctttgggtgaagacttttctatataatagaaatatgaaagcctacagtgtgaaaagaagacaacaatttttcaaaaatcgtaaaacataaaaggatagtagaaataaacaaaattaaagcctttttgaaaaaaactaaattaaatttttgagaaattgaagctgttgggggacaattcttcatggatatctttcatttctgcatggctcaggccttctgaatgaagaacactttttaagaacagccttgggagctagagatagtgtaatcctctgcagagattaagtgatagagacatgcctcgccagagacattctatgttaataaagatatgaacctcttctccacctagaatcatttacttacattccaggataatgaggaatctctctctctagaggggaggagatgggaagatgctccaggagcccaatttagctaagagtctccgaattgggggattcctctcctgtgatgtaccctgctgcatacacaggtaacatctggtcctcatcacatcactatgcagtgattgggatgtgggaaccagtacatgatgctctttggctgcggtttttgcagggagtaataaatgatctgttttgcaggctcagggatcttgtgctcttatgtcagtatatgtagataaagctggggcagtttaacttgttatctttcaataagagtaaaatcttggagcctttgcagttttatacttagcagagacaatgtgtaaattttattgtttcatttggtgttggaaaaagaaacataaatattttgaatttatcatctccatgataaccaaatataagttattaggccaggcacggtggctcacgcctgtaatcccagcactttgggaggctgaggcaggcggatcacctgaggtcaggagttcaagaccagcctggccaatatggtgaaactccgtctctactaatagcacaaaaattacctgggcatggtggtgggcgcctgtaatcccagctactcaggaggctgaggcaggagaattgcttgagcccaggaggggaggttgcagtgagctgagattgcaccatggcactccagcctgggcgatacagtgagactccatctcaaaagaaaaaaacaaagtcattaaaattcaaaaacctatgcaaatataaggagacgggtccagtaactcatagtgataatcttaaactcaaatagaatggacattggtggcactgtaaccttcagatgtggaacgtgctttactgcatttctgttcgataaatacttgtcacatttgatgtttacatgcagaaatacaagttgcatatgtatatgtctatattcatatttttgatcacctttttcttcagccttcctgtcttctttcaccagatccaattactttattttgcccccaccctttctgcccagtgcctgcccactctccatcgcttcactgggcctgtgacttttgccttaacagattttggcaccttgcctgcagctgtgggtgttgggatgctcagtgtgctttattgttctatgatgtgtttttttcagctcttgaagtttatcagttttgtcctgtttctcagaagggtgaataacagccaccagccaccattgactgatgagagaagggattgtctgccctctctatcatccagggaccccttgtcagtcttctacagtgaccttattccaaagactatctgagccttcagggtttctcccaagtaaaccaagagacagacacatgttggggacctgaattaaaattcaagaatagctcccttgacagtgctcttagtgtgtttcagatactctggcagtgaaagcaagccattggaatttttttaccttcttcatatttggtcaagctgctccctctcaattgctagtttctttcaagtggcagttttattatccattgtcataacaaacatttctgattgctttattcaaaaggtccactcaaaatatgctataaagatgtttcctggaaaattgactgttgttgcttaaatgcacatttgtcagagagctctaaagaactagcaagtttctacatttacataagattaatttgcatcacaacggttgctatttcaatgcctttagtttttcttctttaccattagcttcttaacctcttgtcttcactgcgttgttttaacacagcactctctgcttgtcagtgataacactgaggtggagtcttcaatagataatattgcattgtttctaggactaggttgaggtgcccttgcctagcttagatctcttctactactggctctcatcctacccacaccaaatattctaaaataaaatgtccctttccctgtattgctatttagtttaactctctctgctgctcagtagagtgggaaaagagctggagaatggaggtgagtcactgactgaaaagtacaggaggtttggaagagatattacctagatcagggtaaccacaggaaccttctttgaaatcgctattaaatgtggctgagacaggtttgttctcggcacaacttcagtgacccaaccactataattccttctgatctgaagtattacatagaggagaagtggaggaaagcagatatgtcaggagttgtattccagggctgggaatggtaaacactggacaggtgagtgtgaatgtcagtccatcaaatcctagtcagagttaaatgggaacttgaagctcagctggatttgggtttagggatcaacaaaagacaggaaatggtggagggtaatgacaaaattcaaagtgcttttgtgaagcccacgttgtgataagatcagtttgggtcttaagatgagatgcctgtagcatatacaggtggggataaccagggtgggaatgaagaagagagactggctaaccagaagtctttatcctgctttgttgatgttgctattcctctaattatttcttcccctctagcttttccacttgtatatattccttcattaaagaattacaaagcaaggaggatgtatgggacagtgtaccaggagacatgcaaattagataagacagtgttcctatctttggaataaccctattacaggagatgatggtctaggcctgtattttctaaactacatgtgaagagtcattactgtccccataagctctaaaatgttttctgatgttttatttctatagtcaaagaagtttgggaaatgctgtataatacatcgctcttagatgatcactatgtatattagcacaggaaaggtactgacataccctgcaatgcagaaattgtttaactcattatatcatcaatgtatttgaccatagaactctgttttttctcataataatttacaatatcctaaatgaaggaattcttggaatatgcttataatggagggcttaaagtgtttgtctagtaactccaacatctggacttccacaaagacaatttctatcgactgctttgtatcctgtttgtgagctatattgtcttgcaaataggaatcatcacacagtcaaagctttgagtcaggtcacatagacctgactctgagaatagaacttttccatgagcttccagacaagccaagtaatgacagttctctgggcatgggactttggtgtagctccaaactgttctgttccatccagtgggtgctaagcttctggttttcacagctaccattgttatgaatctgttggttttcaaggctatgacagaacttagggagaattatagaattagggcaagttaaaatgctacaagacttgctactttttctgagattctgcaatttttcttgatcatatactccatgaactgttgtaagcctttagttaatttctagagctctgataaagttgatttttatttatttatttatttattcatttttgccagtgttctcattgcttttatgataagcagatttggggagttcctactccatccttccctccatgcattttttttatgtctctttgtctgcatttttgttatttcccatgctaggaatgtccacattctctgtctattctgcttggaaaattaccagtcatgcatcaaatgtctcacttttcaatgtagccttcaccaattgcctttggttctttccttcccatgtagaactaattgtgcttcatatgactttgtttatatattttatagtactaatcatattgctgtgcttagtcatttcagggctccacatttggtataaattcgtgtactgcacaccccagagcatactgcccagagtaatcttgaatgtgtcccctgtagttatgtaaagaaccatctgagtggtcatacctgggtatcctgtgactattccaccagttaacatgaaatacttcagagagaaacaagttctgattcaaatgtgcttgcccaagacttttttccagaccagaacttctccacagcacatattcaattattttttaaatgaataaatgaaatatattcttcttacctttgttaacacacggcaggatcttcctcagaaagacttacaatgtagaatgtgaacaagaaatcaaaataactgaacctatagagacctataactgccatagattaagaataaaattctcattatttccacagtgagggagaatgattagcaaattcatgaatcaaccttatgtttattgtggaatttttacttaattcatactttaggctttgatttacatgtttccatatgtcttactaaggaatcaggttgcaaaacaacagaagttgcttagagacagctgaagcaaaaaggaatttttgttaaaaatcagagatatttcatagaaaccaagtacagaacttgaatggggactcttaagagactggaagtcagcacttcagagttcacagccaaggtccctcctccagtctctcttaggctactctcatggattagcatctcttcctctcttcacacatttgcatatctactttattctttttcttctccccaaaaatattcatgcacatggttccacagcccaggcttcaaatactttctcttttaaggcatctcacagaaactaactagaatttctaagtccctgctttaaattccccctagagtgaatctgttggacaaacttagatcaagtgtgaacagctgggataaatggctgttctcaggtcgcaagattacattgcttccttgctactcacttagccagatctatgggagctcactctctagaaggaagtaggcaatgaggatggggctgtaggtgatagggcgtttaactggatagccaactatattactctgctcaaactgctgtagcagaatatcagagactaggtggcttaaacaacaactttatttctcacagttctggagactcaaagtccaagatcaaggtgccagcatggttggtttctgatgataggtctcttcctgacttgcagatggctgccttcttgctgtatcctcatagggcctttcctctgtacccactctgaaagagagagtgatttctgatctctcttcctcttcttatagggacaccagtcttattgaattagggccctacccttatgacctcatttaaccttaactgcctctttaaagacccaatctccaaatgtgttcacactgggggttagagcttcaacatataaatttaggggagtgggaggcacaattcagtccataacagcatccccaaaagtatccacaataccatataaaatgatgcctgagtgtaatttctgagcacaatggacgctgtttttacttacttattaatggtcacttatgttctggaatcgtttaagatgggaaagaataattcatgacttagttttactttttcatgacagatattctttttctctttcacacacacagagtatatacggtcatgtataatcaaattttaatgtataatctatgctagtgaagctgtagagtgggtattcagattacctaggaatcacaagtattgttgtaactgttctattctagcaatcaagtgttctgcaggaagaagcagtacaattcagatgatacaggccaaaactttgccatgcctttatatgtagacatacaaactttaaacttagtaggaaaaggttgtctattagagtcatgtagatatcttcatcctatctcatttggtaagggagaggactgcagggcaaggaatcatgaaactggacctcaaagcaacagaagcaagtagatgtaatagcaaagctaagggaactctataatatgcagaagtcaaattaaatacatcatctttatcctactacgcaggagattgtaacaatttaatggggactggaagaattcccctttaaacaaatgcttctcactctgtcactgaaattcattcactcaaagccaatgacttgctattcaaatactacttgggttccactctgaaagcaaaaatcctaatatctcaggagcttaggtatattgttctattgcaagcaaatacttctgaacattttggttttcagagagctagtaatatgaaaatattttcaaactttgagcaaatcaaagactgcccaaagaatgctaccctaactctgccatgcccagtatagctaccaatgagaggaaaggaaactgacactgactaagcacctactatgtagtagtacatacattatcttatctatccagaatgtttttatttcttgtaaaactactaataatcagacacctccttcaaatatagaagaaataaatgaaaatctaccatatttgtcaataaattaatatttgtaatttttgttatatagctataaagcatatgcagtgtaacatagtgtttagggataagaactctagagtcagaatgtcaagttttaaactccacctcttattacctatgtgaccctaagcaaattacttaagctctctgtgcttcagttccctcattattaaaatggatataataataatgcttacttcattgggttgttggaaggattaaatgaatttataaatgtaaattcttagagaaatgcctggcacagaattagtactatgttagtttttgctataattacaacttctattatttccatgttaactactgtggtaggctcactctaaaatggtccccacttcctggtattcatacccttgtataatcccttcccttgaaatataggtgaaatttttgagttgcttctaaccagtagaatacagcagaggtgataagaggtcactaaaatgattaggctaaacaaaactaagatgtctgtcttagactctattgacttgcatattttgatgaagcaagcatccagattagaaagatggcctgtgtgggccagctgcagtggctgatgcctataatcccagcactttgggaagccaaggcaggtggatcacctgagatcaggagtttgagaccagcctgactaacacggaaaaaccctgtctctattaaaaatacaaaattagccaggcatggtgttgcatgcctataatcctagctacttaggaagctgaggtaggagaattgcctgaacccgggaggcggaggttgcggtgagccgagatcgtgccattgcactacagcttgggaaacaagagtgaaactccatctcaaaaaaaagaaaaaaagaaaaaaaagaaaggtggcctgtgtggaaaaaaattgagggaacttccagccaagaaccatctgggaactgaagttgcagtccaacaactttcaagggattgaattcttccaacaactatgtgagcttgaaagtgaatactttcctagctgagccttcagatgaggctgcctccctggcctacatcttgactgcagcctatgaaagaccctgaaacagatgacccatttaagacgtgccatgactgctgattcataaaagttgtgatataataaatgtgtgtttggtatggtttgaaatgtgtgccccaaaagttcatgtgttagaacttaatccccagtgcaacagtgctgggagatagggcctaataagaagtggttgggtcatgagggtggtgccgtcatgaatggattaatataagtatcttggaaacaggttagttattgcaagtctgggttgttttaaagtgagtctggcccctcgtgtctctctctctgtctcatggtctcatttccattttccacatgggatgacttttgccagatgatggcattatactcttggacttcccagcctccagaactgttttcttttcttttcatttcatttcttttctttataatttatccagtctgtggcattctcttacagcagtgttgttttaagatgctaagttttgtggtactttggttgcagcactagatacctaatatccctatatagtgcttaacacaaagtgattgctcagataaatattaattttctctccatcctcagttatatttattttttaatgtgatttttgcccaaaggcaattctttgaagcattgtttattataacacacacgggattggctcacacttggcttatgtctcctttggtcatcattattctgttgttttggttcagtttcttcaacaatactaaacactgcttatgaagtccctacatgcagcaagcagagtatgtaccaagcaccttatccatattatcacatctaatcttcataaaatccctgaaaggtgactgttatttccttcattttaagggaggagaccaccactcatattgtcttatgcctaatttctgcctccaaagaaagaaaaagtaaaaactaaaaggcagaaatgacatccacaagcagacagcccagcaccacaccctgggccagtagttaaagatcgacccctgacctaatcagttatgttatctatagattacagacattgtatagaaaagcactgtgaagatccctatcctgttttgttccgatctaattaccggtgcatgcagcccccagtcatgtaccccctgcttgctcaattgatcatgaccctctcatgcgcacccccttagagttgtgagcccttaaaacggacaggaattgctcactcggggagctcagctcttgatacaggagtcttgctgatgtccctggccgaataaaccccttccttctttaacttggtgtctgaggagttttgttcctgctacatttcttggttccctgaccgggaagcgagatgattggcggatggtcgaggcagctcctaaggcggcttaagcctgccctgtggaacatccctgcggggctggaacatccctcggggaacagcccgagcgacacagatcctgagagcgctcccgggtaggcatttgccctggtgggataccttgccagagcagtgtgtggcccctgtggaggatcaacgcagtggctgaacaccaggaaggaacgggcacttggagttcagacatctaaaacttggtaagactagtctttggaatttgcccactccatttgagtggaagcgtggcctgatcacccatggcatgcctttatcagcactttggttttggttttggttttgacttggtttgaattgcttgacaggactggtcttgggaacttgcctactccatctgagtggaagtgtggcctgatcacccacggtctgcctgtaccggcactttggtttttgtttttgacttgacttggattgcttgatactttggtttttgttttgacctggcttggatttctggatactctgattttggttttgattttggtttggtgcaatctgcaaaagtgtgtgtgtgctctttttacccgttctttgttttgcggtgtgcgtgtggagtaagcatggtgttttgtcttgaagaagcacaggtcaggcacaaataagcccaccctactaggaactatgttgaaaaatttcaaaaaagaatttaagggagactatggagtactatgataccaggaaaacttaaaactttgtgtaagatagactggccagcattagaggtaggttggccattagaaggaagcctggacaggtcccttgtttcaaaggtatggcacaaggtaacctgtaagccagggaacccagatcagttcccatacatagacacttgcggtcacagctggttttagaccccctgcccccaacacacagtggttgagagaaaagcagcataagcggctggcagaggcaagggaagaccagcagagagagagaaaggaaagagacagagaggaaaagaggcaaagagagagaggaagagatagagaggaagagacagacaaagagggagtcaaggagagagagagagaaagaaagagagaggcagagagagagagaggaagagacagaggcaaaaggaaagtcaaagagagagagaaaaagtcaaagagagaaagaaagagagatatacaagtagttaacaaaaaaaagcgtaccctattcctttaaaagccaaggtaaatttaaaacctataattgataattgaaggtattctctgtaaccctataacactccaataccactttgttttcagtgtaaacaagggcatatcccgaaagcactgaggccttcctatcaaaaatccttaacccagtaacctgcagatggcccaaatgcattcaatctgtatgggaactgctttgctaacaacaacaacaaaaaaaagtaaaaaaaataacttttagaggaaacctcattgtgagcacacctcaccagttcagaagtatcctaagggaaaaaaaaggaaaaagggggtgggggggcggaaatttatacaaaaagagtattatatggtaaattcttgccctgaaataaattaactgcttatttaaagaaagaaatatttgtaataagtcagaaagttgaggcatgtcgaagaattgtctgcgaaagtcatgaaagagaaaaatgttataaaaaataacttatgcaaaaaatgttgtataacttaaaagtaactaggccttctgaatgtaaaactattaaaaaaaaacagttgatatgcaaggtgtataagaaaagtaaaatatacctttggtaaaacgattataaggaggcataagaatgtacatttttacctatgttaaaaagttaagaaaattattgttttgaaagtttaagcaagttttaaaacattaattgtaaagaaaattctgtgtgtaaacatattagctaaagttaaagaagtatcatccagttttccgtgaacaggacattaaagtaaaagcataacaggtttttcttaaagcaccaacctgctctttagcaaaaattataaaaggttaaaaagagtctataaaatcttaccttatgggtaaacattaaaaattagataaatatgtctacaaggttttattaaaattaggtttaacattaataacacactaatataaagataaaatttagtttatctggtataaaaatcatacgagaagcactgttaaatgtaaaatggtatttggctttctttggtttaaaaactaataaaaataggtgctaaaggaaatttctcagtaaaaaggcactaaggacaataaagtccactgccgaggtccccacatttaaaacaaaaggtcaatttcttaaaaattgtatacttggtttatcttccactttcctttctctcaaaactaaaagtcttttagcacatgtaccacccctagaatttccggtaaaccagcaccagcctgaagatcgtgttcccatcaaaaggtggaaagaagaaaaactcgagccagcctgggaaggaccctaccttgcgctgctaaccaccaagactgctgttcatacagcaaaaaaaacaatcaaacaaacaaacaaaaggatggactcatcacacccgagtcaagaaagcgccaccccatccagagtcgtgggccatagtcccaggggaaaaccctatcaaactaaagctaagaaaaatttaattcttttcatctattctattactctttcttctttactcgttctattgctgaccatctagttattaacataaccaagtcaattttgcctcaaactattgcatttcttgcttgccttgttaaaccctgtgaggacttgctaagtcaaagacagctttctacttcagaaaattacttctgtccctcctgactctcctcagactgggcattagtaaactaggaccatttaatccggggagatttcgataaagaccccagtgccaaccaggagtcttgccccccgatgtagagctttcatgccatagttggtccaacgttctgtggaccactaaagagcaaggatggaaagccccaaccggtttttgtaatttcctaaaaccatacgttcattttactaaagaatcatagaagttaaagacttaaaacaaactttagcaattaagacaggatatcaagatgcaaatgcctggttaaaatggatcaaatattccatctgcacattaaacaaaagcaattgttatgcttgtgcacatgacaggccagaggcccagattgtcccctttccactaaggtggtcctccagtcgaccaggcatgggctgcatggtagctcttttccaggattctacagcctggagtaataagtcattccaagctctctctgctatatcccaaattctggcaccctgcgggtcagcccctgagggccatccagcctccgtctcccaacactaagttcacttcgtgtctctcatgacagggaggaaacttaaagttccttggagacctgaaaggatgcagtgagcttaagaattttcaagagcttatcaatcagtcagcccttgttcatccctgagcggatgtgtggtggtattgtggtggacctttactgggcactctgctgaataactggagtggcacttgtactttagtccaattggctatccctttcaccctggcatttcatcaaccagaaggaaaaaaaaaagacatcataaagcgagagaagccccttatgggtctttcaactctcatgtctatttagacgcaattggagtcccacaagcaataccagatcaatttaaagcttgaaatcaaacagctgcaggatttcagtcaatattttggtaggtgacagttaataaaaatgtagattagataaactacatctattacaaccaacagcaacgagatttccaagagttaaaagaaaaactcatgtcggcctcagccctgaggctacctgacctgacaaaactctttacactctatgtgtcagagaaaaaatggcagttggagttttaacccagactgtggggccctggccaaggccagtggcctatctctcaaaacaattagacagggtttccaaagcctggcccccaggtctaagggccctagcagcaacggccttgttagcacaagaagcagataaactaacccttaggcaaaacctgaatataaaggccccccatgctgtggtaactttaatgactaccaaaggacatcattggtaaacaaatactagcttaaccaagtaccaaagcttgctatgtgaaaatccccacataaccattgaagtttgcaacaccctaaaccctaccaccttgctcctggtatcagagagcccagttgaacataactgtgtagaggtgttggactcagtttattttagcaggcccaaactccgagaccacccttaaacatcagtagactgtcagtggtacgtggacgggagcagctttgccaacccctgcaaagtgactctgaagaagacgacaagccctgctccagtcacacccagaagctgactggtccatgcatggccaaagcatgagaaaactcatcgtgggactcattttccttaaaatttggccttttacagtaaggacttcaactgaccttcctcagactgaggactgttcccagtgtatacatcaagtcagtgaggtaggacaaaaggttgctacggtcctattattttatggttattataagtgtactggaactctaaaaagaatttgtttgtataatgttaatctatacaaggtttgtagcccaggaaatgaccaacctgatgtgtgttatgatctatctgagcctcccatgaccacagttttaaaaataagattaaggactgaggactggtgggggctcataaacgatatgagtaaagtgttagccaaaacagaagaaaaaggggtgcccaaacaagtcaccttaaaatttgatgcctgtactgtcattaatagtaataagttaggaataaggtgtggttctcttaactagaaaagaggctatatggcagaaaataaatacaactgtcagaaattagcactgtgtggaaataaatgtaaacactggtcttgtgtcatttaggccacttggattaaaaaaaaatgaaaaggatccagtccaccttcagaaaggaaaaaatggcccttcctgtactaagggacaatgtaaccccttagatctagtaataaccaatccccttaatcctcgctggaaaaaacagaagcgtgtgaccttaggaatcgatggggccagactggatcctcgagtaaatatcttagttcgagaagtttacaaacgctctcctgagccagtgtttcaaactttctatgatgaactaaatgtgccagtaccagaaattccaggaaaaacaagaaatttgtttttgcaattagccgagcatgtagcccagtctctcaatgtcacttcatgttatgcatgtggaggaaatgtaataggagatcaatggccatgggaagcccgagaattagtacctacagacccagttcctgatgaattcctggctcaaaagaatcaccctgataatttctaagtcctaaaagcctcaattattggacaatattgcatagctagagaaggaaaagaattcactcaccccataggacaacttagttgtctgagacagaaactgtataatggtaccacaaaaacagtcacttggtggagttcaaatcacacagagaatttagtaaattcccaaagttgcaaaccatgtagacccacccggagtcccactgggactggacagcccccactggattatactggatatgtaggcatagagcttacgccaaattacctgaccagcaggcaggtagttgtgttattggcactatcaaaccatctttcttcctactgcccataaaaacaggtgaactcctgggcttccctatctatgcttcctgcgaaaagagaagcatagctataagaaattgaaaaaatgataaatggccccctgagagaatcatacaatattataggcctgctacttaggcacaagacggctcgtggggataccagaccccaatttacatgatcaaccgaatcatacagttacaagctgtcttaaaaataatcactaataaaaccggcagagccttgactattctggcccggcaagaaactcagatgagaaatgctatctatcaaaatagattagctctcgactacttgctagcagctgaaggagaggtctgtaggaaatttaaccttactaattgctgcctacacatagataatcaagggcaagtagttgaagatatagttagagatatgacaaaactggcacatgtgcccatgcaagtgtggcatggatttgatcctggggccatgtttggaaaatggttcccagtgctaggaggattttaaactcttataataagagttataatagtaataggaacccgcttactgctccctcgtttgctacctgtacttcttcaaatgataaaaagcttcatcgctaccttagttcaccaaaaagtgtactacatgaatcgctatcgatctgtcttgcaagaagacataggtagtaaaaatgaaagcgagaactcccactattgagtgagagtctcaaagtgggggaataagggaggagatgacccctcacattgttttatgcccaatttctgcctccaaagaaaaagtaaaaactaaaaggcagaaatgaaatccacaagcagacagcccagcaccacatcttgggcctggtagttaaagatcgacccctgacctaatcggttatgttatctatagattacagacagtgcatagaaaagcactgtgaaaatccctgtcctgttttgttccgatctaattaccggtgcatgcagcccccagtcatataccccctgcttgcttaatcgatcacaaccttctcacgctcactcccttagaattgtgagcccttaaaagggacaggaattgctcactcgggagctcggctcttgagacaggagtcttgccgatggcccctgccgaataaaccccttccttctttaagtccttgtctgaggagttttgtctgcggcttgtcctgctacaatttcacaggtgaggacactgctgttctgacagattgaacctcttttccagggccacagctaggtgctctaaactctcaaaatacaacggaaagccacttccaattatgctcaaagcttttcccaagataaatactatctttatacaaatagtatataaagacttccaagaggttatttctcttctttctccatttcttttccctagaaaattctagaacatcaaataccattcaatctgtccttctctgtgtattgatactgcaatctaagcaatgcccatgctgaagggcagtgagatcaagttggcatcctatatgaggagataccttcatacccagctgtatctgaaaaaacctagacagcaactacaatggaccagagtcaggccaaatgctattgttacaatatgcaaataagcctctaaaacatttttcctcctaagttaaaggcttaggcagaaacagggctgagatttatgcccacaaacatcaggttcaaaattatggttcccatgacagtcataacttacccccaagcatatagatagtatttttagttgttaggttgtagcaggaatgttgcagcctaaaatatatatatgatatgttcagattacagctaatacaggactggtttatttagatttcctttactctaaggttgtttatatttatacgtaagctgattcacttgagtgtgatttttgcacttaaagaaatgtgtgcatttcaaattcaagaggtaataattatttgcaaatttaaattaaagtacttagagcttaacatagccagtgtttgagctcagcactcgatgacaggtagtgggaataaggtaatctcaaagcacattcaaatatttaagtttaggagactcaggaagaagaagggctgtcttgtttataaggtaggagagaagtctcatggttaaaataaactatctaagctaataaatgtgtttcttgtagtattttatgtcctaatgatcctatacacgcatataagtaattcctgtaaatgcattcatgcatgtaaagtcattctcaaaaacatagtataaagcagatatgaacatttaatcttgaaaactagtacataatcatgtgcctgggcctgaaaatgaattctgaagaaggaaggagaaacaggatatgagactaaaggaagcaatatatatttagcttccctcatctgtttggattccttaggtactagcggctactttgggaaaatcgtgagtggattggcttcaggagatgattaaattatctgagtcagtctcagacaacgctgtagaaatgtacctgacacatagcactttttaaaaactactgtagaagtataagtttctgaaataatgtttatatatctaaattattctttgtctataaagccacatatttaaatatatgaagatactaaatgttcttacacacactgatttttttttcttcattcaaaatttgaattatgtgaaaacattgagttccagaagacaataggggctatgaggagtgaaatatttggaataattttaaatgggtaagaaacatggagaaggatatttataacttgaaagtaacattgtatttggttttcctctgagctttgactactcattataaaaatcttggatttttaaaaataaaatttgttaaaatgattcaaacttatgagactgaatcaatatggaaaaccaatcacatgtgcagagttgtctttccaaaggtccattaagtaacagatatgactttttaaagtgacactcaaagtgtggttccccaggccagcagcatcagcatcatctggaaacacaaaaatgtaaatttcttcagcctctccccacatctgctgaaacattgtgggtaggttttaacaagatctccaggtgatcctgatgcaggctaaagtttgagaatacctagtttaaaaaaataaatccaaagaagcccagaaacctagagtaccatcatcagaaaaagtttttcaagccatttctggaaatagaaagcaaaccaaatccaattctccaagtaactatacaagaaaaaacctacaaatcttattatgtgtaagagaaaacatcattaaggtagacgcagttcatgcaaaggattatcttaccaagaaaagtggtcaggtgtgttggggaacttagtggccagtggacagggtgggaggtgtttaagaagctcttggtgattaattaggcagctgtgttgaatggctgactactctcctcattttctgtgcccctcttctaccccactaatggttgcaatataactgctaaagctccagaccacaaagtaaaaagtagaagacataaaaatgacagtatcaacaaactcggctagaattataaatgtgactataaattccaacacctaggacagagacaggcaaagttgtgaacctacagaggatctaccacataagcataattattgtattcagagatttaagaatatattgcattggtgaaaacttttaaatgtaattgacaaactaaaaactcaattgatggacttaattgcagaatggacataactgaggagtagattagtgagttaggaaatcaaactaagcattgttagaaaatttcccagagccaatgtcttcatgaatttctagtaggatttgaaatacattgatggaggaatttcagaacaccaaagacaaaatttaaaaatccaaagagcttccaaacacacaaaacaggttacctatttatattagctgagaataagccctgtctgtggtctgtccctccactctgcaatcactgagcaggtaatgctaaactctgaatttaggatcattacggttgattaaagattttcgtcttcaggcagagagctgtaataatgtgttagtggactatgtctcagcatattagtctgctctggctgctacaatacactgttttaaaggctggaagtccaagatcagggtgccttccatttacgttccccagtgaggactctttcagcttgcagacagccaccttcttgctgtgtcctcacatggtgaagagaaagaaagctctggtctctcttcctcttcttctaaggatacagatcccatcatgggagccccatcctcatgacctcatctaaatctaattacctcccaaaggcctcgtcccaaaagccatcacttcaggtactggagctccaacatatgaattttgggagaacacaatttagtccagagaacctagatattatttgagcgttgcataaaatataaaataatgagtaggtgggcttttgactgatctctattatttcatatttctcttattgcaataagacaaataaaattatgatatgagccaggcagctatagtgtaggcagaccttaaagcaaacaaaattacaaaaacaggtgaaaaataaagagatataaaaagaatgtaacagactaattttggcaaaaagaaaggaagtattgcaatataatattaggcaaaacagaatttaaataaaaaagcatttattagtttttaaaaggcatattttacatttataaaagatataagccacaaaatagcgtaacagtagtaaacttttatgcacctgtgagcacagctgagaaacctatgaagcaaaagctaatagaaaaaccaataagaaattgaaacttttataattatgtgagaatgtgatacatctcttgtagaaatagggagaccaaatagatccaaaaaaggtagtaagtttgttctagtttatattagttctctctttctctctcccctcacccttctttctcttaatataaataaaagctaatactttggaagaccaataaaataaagttttgacaagaaaataagagaaaacacaaacacacacacaaccacaaacagcattaaaaattagaatggagtatgcctcaggtaaaaacaaaaatgttttttaattataagagaagataaaaaataattttgctccagtaaatctaaaaagctagataatatatattatttccaagggaaaaaactgactcaaaaactggtaaaaacaaaacaaaataaaacaaaacaggctgggtgcagtggctcacatctgtaatcccagcacttaggccgaggcaggcggatcacctgaggtcaggagttcaagaccagcctggtcaacatgtcgaaacctgtctttactaaaaatacaaaaattagctgtgcatggtggcgggcacctgtaatcccctacttgggaggctgaggcagggagatttgcttaaacccaggaggcagaggttgcagtgagccaagatcacaccactgcactccagcctaggcgacagagcaagactctgtctcaaaaaaataaaaatgaaaataaaagcttaatgtatcagtaactacaaaataatttttacagacaaaacaaatgacacccctaaaagtacacccggatgttttaaggcaagcctaccaaataaagaacagatcattttgtgccatataaataaatccagaacataaataatattttaaacttggcatataattttgataccaaagctgaaaacataatacaaataaaaaggtaggcctatatcacttgtaaacatatatatacatcataaatatggtattagcatataaaatccatcattctatgcctaagtagggcttatgcaaggaatacaaagattcactatacaaaaggaaaatttgagaaaaataatcattaaacttggaaacagaggacctgtattgtagttctaaatcatgcagatcacttaccctgtctgaggggtgatagtgtttatttttaaaaatctcttcaaactttaaaaacaaattattaaaaataatatttcagagaatggggagaactttttcacaatgctcttgtcaaggattattaagttaaatgtcttaaacacatatttctgtaaacatgaaagtgtttcctgagtcatagctatatggccactcctagccatttaatgaaacaccagatctctgaagtgaaagaagaatgaggattaaatagtacttacattatgctgattactcaaaaagtagttacagaaggtaaataactagggtggacctgtaaattaataagagccactcaagcacatttaattgtcaagagtgaatctacaaaaaagccaaaaaaacctgagaaccattaaatcaaacaatttaggtgaaacattatattttctaggcacagactgaattaactttagattattcctctgcagttaacctacatgagacattaataatgaagtgttgttatgcaactttatgaagcatcatgacataatgcaatatccatggatggaatattatgcaaccaataaaaataaagtttattaaggataaaaatataactttagagagaatatctctaaaataatggtaatttttaaaagcagaacataaaaattttgaacatagtgtgatattagtgtatttcaaataaacacattttatatatacatgaaatgcataatatatataagctttaggtcctcaatatctacaggcatttggattcactctttccttcaaagtcaatgttatgccttcttcaatttttctaaactttccagcctttccttgcttatctacctctgcacgtagttccatttctggcaccaacttctttaaggtggacactcccaatcccattattcctgagaggaccactaacacaaggctattggtgtgaagacctttactaaaaattggggatcacagagggaaattcctataacacatacaggaaactacctaaaacaagctagaataagggcagatttcctgactgagtgttaaatctattgtaaagttacaaaatttaagcactgtggtactgcatccagaataaatggattgaataaatgctatatccaaaaattaaatccaatatatgtatataaatttagaatataattttttaagtgttccaaaacagtaggaaaagaacagacccttcagtagtcaacaagaaaactggaaaaccacttttctaaattaagttagatttcccatctgatgttatattccacaatgaacttaagatgggttaaagatttatacatacaaaatgaaaacattcaaattagacattaataaaagtgaacattgataaaataatcttgcagtaggggaaggaatttctgaaacataagagaaaaaccagaagttttagaaaggaactagcaagtatacttccaaaaagtggtccaaaggaaatacctaggtaagaagacaaaggtataattaaaatggtgcttgagggagtgttgtttatacagtctaaatgtctgaactaatttaaacacctaccaagagaattgagtgaaataaattataatacttctatgcagttagatattatattgcaattgaaaataatatatgtttatatttattgacacaaaaagatgtccaaaaaacttaatcagtgggatagagaagaagaagttacaaaacaatatgtagtgtttgctttttgttttaaaacagcctggcttcctaggctggagtgaagtagcaataatcattgtttactacagctttgaagtgctgggctcaagcaaccaccccgagtagccggggtgggactacaggaatgagatgccacaaccagctaattacttatttatttatttttgttttatttatttatttttgagacagagtgtcgctctgtctcaaaacagagagcctgttgcccaggctggagtgcagtagtgtgatctcagctcactgaaacctccatctcctcggtgtggccacactgcttcttaaagtgggtccccagtcctgttcctcctcactgggcaggacctcccaaatggggcctccagccacccccaccgatgttttctggctgctagagatttgaaaatttcctgggacagacctcccagagggaggggtgggctgccatctttactgtttgggcaacttagccattccagcctccaggctttcgagagcccaagccagtcatgggtggaagcagtaccccagcacagcatggctgctctatgaaagtggccagactgcttctttaagcaagtctctaatcctattcttcccagctgggtgatacctcccaactggggtctccagtcacctcctacaggtgtgtttgggccagcaactggtctgtaccgccctgggacagagctcccagaggaagggtcaggctagcatctttgctgttttgcagtcttcactggtgatacctatagggtactagaagatctgaggtgactaggtactggagtgaatccccagcaaactgcagcagccctacagtaaagtggccagactgttaaaaaaaaaaaaaacccaaatgtcaaaaggtcagcaacctcaaagattgaaggtagataagtccacaaaatgagacagtatcagcacaagaacactgaaaattcaaaaagccagagagccttctttcctccaaatgactgcaagggttcagagctgggttcataactgggctgaggttgagatggctaaaatgacagaagtagaattcagaatatggattacaaacaaacttcactgagctaaagaatcacattgtaacccaatgcaaggaagctaaaaatcatgataaaacattgcaggagctgacagataaaacagccagtacggagaagaatgtaatcaacctgatagagctgaaaaacatgatataagaatttcataatgcaatcacgagtactaacggcagaatagaccaagcagaggaaagaatctcagagcttgaagactgcctttctgaaataagaaaggcagacaagaatagagaaaaaagaatgcaaaggaatgaacaaagcatccaagaaatatgggattatgtaaagaaactaaatctatggctgattggtgtacttgaaagagatggggagaatgaaaccaatttggaaagcatatttcaggatattatccacgagaacttaaactagctagacaggtcaccattcaaattcaggaaatgcagagaagctcagtgacatactccacaagaagaccacccccaagacacataataatcaggttctccaaggtcaaaagaaagaaaaaatgttaaggacagctacagagaaaggccaggtcatctataaagaaaagcccatcagattaatagtgcacccctcaacagaaactctacaagccagaagaaactgggggccaatattcaacactcttaaagaaaagaatttccaacccagaatttcatatccagccaaactaagcttcataagtgaaggagaaataaaattcttttcagacaagcaaatgctgagggaattcattaccaccagatctgccttacaagagctcctgaaggaaggactaaatatggaaaggaaagaccattaccagccactacaaaaataccatgaagtacacagaccagtgacactagaaagcaaccacataaaaagtctgcaaaataaccagctaacttcatgatgacaagatcaaatccacacaaagcaatacaaaccttaaatgtaaatgggctaaataccccaattaaaagatacagagggctgggcgtggtggctcacgcctgtaatcccaacgctttgggaggccaaggcaggcagattacctgaggtcaggagttcaaggccagcctggtcaacatggcaaaaccccatcactactaaaaatacaaaaattagctggggcagtggtacatacctgtaatcctagctacttgggaggctgaggcaggaggattgtttgagcctgggaggcagaggttgtggtgagctgagatcacgccactgcactcaagcaagacttcgtctttaaaaaaaaaaaaagacacagagtggcaagctggataaagaaccaagacccaatggcatgctgtcctcaagaggcccatctcacatgcagtgacacacataggctcaaaatacagggatggaggaaaatctaccaagcaaatggaaagacagaaaaaagcaggtgttacaatcctagtttctgagaaaacagactttaaaccaataaagattaaaaacaaaaagacaaagaagagcattacataatgataaaggattcaattcaccaagaggagctaactattctaaatacatgtgccccaatataggatcacccagattcataaagcaagttcttagagacctacaaagagacttagactcccacataataatagtgggagactttaaaccacactgacaatattagacagatcatcgagacagaaaattaacaaagatattcaggagctgaactcagccctagatcaaatggacttgatagatatctacagatctctctaccctaaaacaacagtatatacattcttctcagtgccacatggcacttaatctaaaattgatcacataattggaggtaaaatattcctgcacaattgcaaaagaattgaaatcataacagtctgttgaaccacagaacaatcaaattagaactcaagactaagaaattctctcaaaaccatgcaattaagtagaaattgaataagctgctcctgaaggacttttgggtaagtaatgaaattaaggcagaaataaaaaagttctttgaactaatgagaacaaagatacaacataccagaatcttggggacatagctatggcggtgttaagagggaaatatatagcactaaatgcccacataaaaaattagaaagatctcaagttaacaacctaacatcacaactaaaagaactagggaaccaagagcaaacaaagcctaaggctagcagaagacaagaaataatgaaaatcagagctaagctgaaggagatagagacacaaaaaaccgttcaaaagatcaacaaatctaggagctggtttcttgaaaaattaataaaatagactgctagctagactaataaagaagaaaagagagaaaattcaaataaacacaatcagaaattataaggggatattaccactcaaaccacagaaatacaaacaaccatcagagaatattataaatacctccatgcacataaactagaaaatctagaagaaatggataaattcctggacacatacaccctctcaagactgaaccaggaagacattaaatccctgaagttctgaaatcgaggcagtaataaatagcttaccaaccaaaaaaaaagcttgggaccacatgaattcacagctgaattctaccagctatacaaagaagaactgttatcataccaactgaacttattccaaaaaattgaaataaaactaactcatcctatgaggccagcatcgtcctgataccaaaacctggcagagatacaacaaaaaaagaaaacttcaggccaatatccttgatgaacagcaaagcaaaaatcctcaacaaaatgctggcaaaccaaatccagcagcacatcaaaaaccttattcaccacaatcaaataggtttcacccccgggatgcaaggttggttcaacatacactactcaataatcaataaatgtgattcatcacataaacagacctaaagacaaaatccacatgattatttcaatagatgcagaaaaggctttagataaaattcaacatcgcttcatgttaaaaactctcaataaattaggtattgaaggaacatacttcaaaataataagagctgtatatgacaaacccacagccaacatcatactgaatggccaaaagctggaagcattccccttgaaaaccggcacgagacaaggatgtcctctctcaccactattcagcattgtattgaaagttctagccaagtcaatcagccaagagaacgaaataaagggcattcaaataaggagagaggaagtcaacctgtccctgtttgcagacgacataatcctatatatagaaaaccccagtctcggcccaaaagcttcttaagctgataagcaacttcagcaaagtctcaagatataaaattaatgtgcaaaaattgctagcaattctatacaccaacagcagtcaaactgacagccaaatcataaacaaactcccattcacaattgccacaaaaagaataaaatacagctaacaagagaggtgaaagatctctacaaggagaactacactccactgctcaaataaatcagaaatgacacaaacaaatggaaaaacgttccatgctcatagataggaagaatcaatatcattaaaatggtcatactgctcaaagcaatttgtagattcaatgctgatacggtttggctgtgtcctcacctaaatctcatcttgaattgtagctcccataattcccacgtgtcatgggaaggacacagtgggaggtaattgaatcatgggggtgggactttcccatgctgttcttgtgatagtgaaaagtttcacaagatctgatgattttattaaggggagttcccctacacaagctctcttgtctgctgccatgtaacacgtgcctttacttctcctttgccttccaccatgattgtggtgctgaactccccagccatgctgaactgtgagtccattaaacctctttcctttataaattacctagtctcaggtatgtctttattagcagtgtgagaatagactaatgcaaatgctattcctattaaactaccattgacatccttcacagaactagaaaaaactattttaaaattcatatggaaccaaaaagagcctgaaaaaccaaggcaatcctaaggaaaaaaaaaacaaagttggaggcattacactacctgacttcaaactatactacagggctacagcaaccaaaacaggtacaagaacagacacatcgaccagtggaacagaatagaggatctagaaataaggccgcacacctacaaccatctgatctttgacaaaaccaacagaaacaagcaatggggaaaggattccctgtcaataaatggtgtggggattactggctagccacatgcagaagattaaaactggacccctcttcacgccatatacaaaaattaattcaagatggattaaaaacttaaaagtaaaacccaaaattatgaaaatcctggaagacaacctaggcataccattcaggacatagtcacaggcaaagatttcatgaagatgcaaaaagcaattgcaacaaaagcaaaaattgacaaatgggatctaattaaacaaaagagcttccgcacagcaaaagaaactatcaacagagtagatagacatcctacacaatagaagaaaatatttgcaaactttgcatctgacaaaggtctaatatccagcatctataagaaacttaaatttacaagaaaaaacaacaacccaattaacaagtaggcaaaggacatgaacagacacttctcaaaagaagacatacatgcagtcaacaatcatatggagaaaagctctgatcattagagaaatgcaaatcaaaaccatgatgagatacatctcacaccagtcagaatggctattattaaaaagtcaaaaacaatagatgctggcaaggttgctgaggaaaaggaatgcttatacactgttgttgggagcgtaaattagttcaaccattgtggaagacagtgtggcaattcctcaaagacctaaagacagaaataccattcagcccagcaatcccattactgggtatatacccaagggaatataaatcgttctattatgaagacacatgcatgtgtatgttcactgcagcactattcacaatgccaaagacatggaatcaacctaaatgcccatcgatgatagactggataaagaaaatgtgatacatatacaccatggaatactatgcagccataaaaaagaatgatattatgtcctttgcagggacatggatggagctggaggccatcatccttagcaaactagcacagggacagaaaaccaaataccacatgttttcacttacaagtgggagataaaatgatgaggatacatggacacatagaggggaaccacacacacaggcctattggagagtggagggtgggaggagggagaggatcaggaaaaataactaatgagtaccaggcttaatacctgggcaatgaaataatctgcacaacaaacccccatgacacttgtttacctatgtaacaaacctgcacatggatccctgaatttaaaagttaaaaaaaaatactcagcaaagtacttaataattctatccccaagacaatctctattaaaaatttaatacatatactgacatcacgggggtggtttctaatggtttagtaccatccccctagtgctgcttgtttaaaaatgtgttagcacctcctcccccaaccccaccccttgccattcacgtgaagatgtgcctgcttccccttcaccttctgccatgattgtaagtttcctgaggcctcctcagaagcagaagcctgtatcgtccatagaaccatgagatgattaaacctcttttctttataaattacccagtatatctttatagtagtgtgagaacggactaatacacaatttgttttatgtatatgtgattttatgtatatatgattttacccttacacaatttgttttatgtatatatgattttgtttcaaaaatggcatcatatcaaaatttttttcagattagcagattcctctccttaaccttctgattaaaaaaatgcagagtatcagttttcttcaagattcttcctgcttctttcacagattagaccaggcatttatttgcttttcatttcattcaactccacccataaatcctcaatttttcaggtccttttattataaggaggcaataattcatgttcacttggcttgtctgtccagacttgcgtgtctgtctgactcatgcctttcacccagtcttggttgggctgactttgagccttctcattactgggcttatatggtcctaattacacgttactggggtacacacagaaatcaccaattagtttttgactttaaacagatcacttacctctctggggtaagtgattcatgcaattgttttccaatcgactttttagcatcttttgcacacctaaccaaatgttgggaattctacaattaatatgacccagccctgccttccaggaataatagggaaaagcagagaggcaaataaccacagataggtaaaagtccatgtaaatgaagagaaaaagacagccttgaaagagtatgaccacaggtttgccaaatcccttttaaactctaaaaatataccactccaatggaaagaaagtaattttttcatgatctgaggtactgtatttagatttcctcctcaaaaacactgaaaaatagggatggaacttggaaatatgtaatgtgggttgactcgtatattccccaaaatacaagcctcccaaggtggtctggaattgccaccaacatttggacagcaggggtggggatgttcctgtcagtgtctgccacatgggagagtttcatgaatatttggtgaattaactagtaaataattagcagacataacagaccaaagtagaggaaactgtatagcttttttttgttggtatggatttggcaaaggctaagacatgggaaatgtgactctggggacaacagtggagcatgaattccttgggacatgaacttgggccgttattcatcctgctgtgtttccaaagctgattttccagcaaaacaataataataataataataataataataataataataataataatgacaacaacttagcaagcttggagataagttaccagaactcatagagttacagattaatgcttcggcctacaacaaagtgaaacatttttcaaacatagaatatgcatttaccattaagcaggcctaccacaattctatgtagacatttaaattttggcaaatcatttacgatgtctgtaagtttcagacatgtgtaagaaggagcaatgacagacttctctgtggtatgcattgcctgcttcagtcagtccagtgacattctgggcttccaggtgtggcaatcaagcaggaagtgtgctgggagggtcacagcataaggcagctgcccggggagcagattcaaagcacagctgtttggctcagagaacagcagataggaagaacacttctgcctgctacagaaatcagctgggatatctgctattcttgcaaattggtctatattaaatacgtaattcagaaactaaaattaaaactaaaacgaagccacaatttctggagcaatcttcaaacattccagtcatagcagcacttcttttaatacagccagctatcttttgaggctaaaaaggaatttcctctaagcagaaaagtctgaagagagttcttcaaagatccttgaggggagctcatctgatagcaggaaaggaaagttcaagatgcctcagagactacatgtatggaaaaatactttacactgtcaaggggagaggaggtcatcttagatgatacatgagaatgcagtatctaggtagaaatcctgctcaaaactaaaagaagagtatgtaaagctataaccttgtaaaataaggactcaagaatgtgtgtgtgtgtgtatgtaatacattatatatatgattgcacatatattaaaggcaggggtgatgtccaaaatatttaacaactgctgtaacaatatacagtgatcaatggccttagtttgtctggaactaagggcttttctgggacatgggaatctcagtgttaaaactgggacactcctgggcaaattgggatggttgctcaccccaggcactaatcaactgcaatacatgctagcaatacacaaccaatgtggccttaataacaacacacctgatctctcatccttaatacctgaggatgtttgtacaggataagccctgggaaccatgcagtcttgcatttctccaaattgctcatgcatttgcctgcctctgtgcctttgcacacactgttccctccacctagaaaatcctttcctgacttggccaacccctgtcacttcctgcaagaagacttcctggcccttcaaaaactatattaggcacctccctgaaggtcatccctaggactctgtatttactcctatatttagaattttggaggaaaagataaagcggaaacataaatccaaagaagcaagactatgaatcccaattcatttatgaatgaggatgagtgggagagcaactccccaaattcggaatcaaagtaattcagtgacagttggtaatgttctccaggaggccactaaagctactacggtcttttgttcatgctgccagaccctccaggcagagtagaaaagaatctgaacctgatgattttaggcacaataatgaagacgagattttctgcaggtgttaaccagagttctgctaattaaagaatttcctctcctcaagtgatccgcctgcctcggcctcccaaagtgctgggattataggcgtgagccaccatgccgggctcacagtcaacttgagtttggccatgagccagatgaggcatgggtgtgaactcaggtggaaccaggtcaggaatgggggaacacccaagggactgcatcagttagggcttcggcaggaaataagtggcatgctcgtaacaggaaaattgaaggaaattttaataaaaacgagagatcacaaggggttagtgaaatatctggggctggtagagcaggtgttaccaccccaaggcctgaagtggagtaagggagggagtggttaccagaacccaacaacaggaagggctgcctgggaagggccatatgacaagagcttgacactatgggggcaggactcagccagcaggccgtgacatgcagaggcagtctgtgtgttagttaatggtatacagtaggtgctcaataagtgtttgtattaatgttcctgttatcattattactgctttttgatacacattatatattccatgacatctgatgttttcccattgaagaggctgaagtgtcaagggaataagggaaaagtaaaggaaggaggcttcttcattacattctctccagcaccaagagaagacagtccctggagatgttaagaaacagaggctactgtggcagccaagaaacccagaatgccagagacagcagagggatatctgcaggagagatggtaaggccaaacttctggattgcctcatgttgtttaaaacatccgcccctaggaaagggttgggaggctcacaaattcctgttatacttaaaagaggaaatagaccagaaaggtgaaattgagtttatgtaaaacaatgtatgtattacacagagaaatgaaaactcttcagtaattcattggcgatcttagcacatgtctcagaaagcagagaaaactggttacctccaacaactgcaaaaagtcatggtctgcataaactttgtcctgtataattggccacaacataagagcatttgcagaaattgatgctgttcaagtgtcccctatatttgggaagccaggattttgtcctctctacccccaataagtataatcttttataataaaaatttatattttgacaacctgacatagctatgtttaaaatcaaaaattagtaatggcaagttaatagaattctgtggatccatgagtcacaaagttcagcatcaaataagaacacagaaacagagaatgcagaacacaatttctgccaggggagtaggaatgagttgagggcaaacaagggactaacaccaagaacacgtaagatagaatccctcggcttaacatttcagtcttagattaccttgactgttttgattcaagaaacttgaatagatattgataggttgtggaatcctttttttctgtcacttagttttagatttgtttttttttaaacagttttattgaaatacaactcacacatcacataattttcccatctaaagtgtacaattaagtgaatattagtatattcacagatacatgcaacaataaccacagtcaactttattatttttatttatttatgttttattttttagacagagtcttgttctgtggcccaggctggagcgcagtggcacaatctgggctcactgcaacctccacctcccagattcatgcaattgtcctgcctcagcttcctgagtacctgggagtacaggtgcgcgccaccatgcctggctaattttttgtatttttagtagagacagtgtttcaccaagttggcaagactggtcttgaactcctgacctcaagtgatctgcctgcctcagcctcccaaagtgctgggattataggcatgagccaccatgccggacccacagtcaactttagaacatttttatcacctcagaaagaaaccctgtgctctttagatattgcctatctgtcccccatcttcccctgccacctcccattccaagcaactactaatctatcttctgtctccaggggtttatctattcaggccatttcatataaatgaaatgatataatgtgagatcttttgtgactatctccttttacttagcatgatgttttcaaggttaatctacgttgtcacctgttatcactgcttcattcctttttatggcagaataacattccactgtgtaaatacaccacgttgtattactgctcatcagttgatgacaattgagttgtttctatctattctaagatgcgttaatgttgctataaacatgcgtgcatgcatttttgtatggatatatgttttcatttctcttggatagatacctaggggtggaattgatgggtcatgtagtaactccatgcttaactatttcaggaactcccagactgttttccaaagtagctgcaccattctccattcccatgactccatttttcttacttcccttaggactgttaaaaagttagtcaacttaatatccaagtgaaagcacaaaatactggggtggtctatacacagtcacaaccacgaataattctcagaataattccgctttcactttcctatccattcccaaaagtatactgaccttctacagcaagtcacagcaaatcttgagcagattcacgtaagaactctgtagtcctttgtagtagctctgtgaaatgcaaacaccttatgtattttatcttcaaaaaggaagtgagatagataggaagggcatgactgtctccatgaagcagatggaaaaacaaaaacacaggcaaattaacttcacttgccttaagacacatctaagtggtgatgtcagagagagtatcacatatttcaatctcttccctcaaggaagttataattgagtaggaattataaggtcttactaagatcatacatgataacagtacaagctgcatgtgctatgagtcaaatgaatgacaagccaaaatgtaataagagcacggtaaaatgtgagagcagcgggataagcgtgtactggggaggatgaaggaagatataaggaagatctcctgaaggagaagaaaaggtggcaccagaactgagcttcagaggatgcataggagtttgagagtttgactcagactaagttgagagaagacactcctggcctacagagcaacaaaaccaatgacttcgaaaatgcaagcagagccaaggaacaatgggtagtccaatctgagtggaaaatattcccttaaatttagctgagtagtaacaggttgtgagattggttatagatgacagattaaagaatctggtcttggccaggcatagtggctcatgcctgtaattctagcactttcggaggccaaagcaggcagatcaactgatgtcaggggttcaagaccagcctggccaacatggtgaaaccccatctctactaaaaatacaaagactagctgggtgtggtggctcatgcccgtaatcccagctactcagaaggctgaggcaggagaatcaattgaacccaggaagcagaggttgcagtaagccaagattgcaccactgtactccagcctgggtgaaggggtgagactctgaaggggtgagactgtctcattaaaaaaaaaaaaaaaaaaaaagaatctggtctttattcagtaggcagtagagaaacactggcagaaattttagcgaaggattttcataaacaatgtggtgttttaatgatactattttggcaatgctgtataaaaaaaaggtaaaaggataggtaatgaaagtggaaacagtagatataagactagcaaagtaggccagatgcagtggctcacacctgtaatcccagcactttgggaggccgagatgggtgaatcactcggggccaggagtttgagaccagcctggccaacatggcaaaaccccatctctgctaaaaatagagaaattagctgggcatagtggtacatgcctgtaatccccgctactcaggaggctgagacaggagaatcacttgagcctggaaggaagaaattgcagtaaaccgagattgtgccactcaaactcctatgcattttctaaagcccagctttggtgccacattttcttttcctgtagtgaacagacatccctttgagacaggggactctgtctcaaaaataaaataaaataaaataaaataataaaatttaaaagactagcaaagtagtccaagtgtaaaataacaaatgtctaaatcagagattctaaaccaggggattattttgcccccataagacatttccaatgtctggagacattttaggctgtcataccagggagagtgcttctggcatccatgaagtagagacatcctacaaagcacaggagaataccctaccaaaaagagtcacctgacccacaatgtaaatagtgcccaggttgagaaaacctggtctaaatcaaggtggtggcaagggaaaataaaagcaaatgacagatatgagaattactttcaaggaaaaggtgataggatttgatgactgattgggtttgggggcaaaaattggggagtagatagtttataacttgcgtggttgacaaaattatgacagcgaaaacaattttttttgagacagggccttgttctgtcacttaggttggagtgcagtggcaccatcacagctcactgcagccttgaatttccaggctcaagcaatccttccacctcagtggatctacaggcatgcaccaccatgcccagctaattttttttccttccttccttccttctctttctttctttcccttttttctcttcctttctctccctttccctttccctttccctggctgatctcaaactcccgggctcaagtgatcctcctaccttggcctcccaaattgctgcgattataggcatgagccagtatgcctggccaaaaaccaaaacttttttaaagaaattggtagtaggaggaaggaagagtgtagtgaatatatattttttaatcctctcagtatcccaatttttggaaacaacctctttcccaaaatgtaatgtgatttgggtgaggaaggtaacacccgcaaccccaccccaaatggtactttccttacctaggtctggccaatcagaatccactgtatacttggcctcagggaatggttctctaggtgggcatgcgatcctgcaggaattctacgcatatcacgcatgaagctagcctgtctgagagcaaaattaaacaaaggcaggcagaggagagtgagtgaacaagagagagagaatgaatttaaataatatcgtttaagctcctggattctgctatgcctgaaatacaagatttagatttagatttcccagttagattaagcctatatgtttcctactttgcttatgctagtttgagttggatttctatcacttttaaatgaaaaagtctcagctaattacaaaaggatgagattagttttagatatgttagtagatggaaaatatattgaataggtgtaatttggggagtggctacaatttaggagattggattaaattagaaaatacattttggaaatcatttctttatatgttacatttggatgcgagaatagttgcaatcctttgaaacaggccaaggatagacagaaatactttgtattttataatttataataaaataaaagggattataaattatttaagaagtctaaattattaacttgtgatcattcagaaatagtaattccaggaaagatgttggaaacaagttacttatgagctattgaattatttgtagtttccaccacatgtagaatagctttgaatgtgttcaattctgctctatcaacatgttaatcatttgcccatttactcttagatttcttttttctgcttcccctgttctgctctgtatcacagagggttgatttctgaaaaacacattaccagtgcttctttgctagctggcttctgtttagtttggttagtaagcatcactggcaggagtctggaacgtaggcggggagaagccagtgaatgctcctccattcctcgctttggccagtacttctgatattgcttgtgtctcctccgtggtcccagcttccctggggaagccttacccttggtggtcgcagcacccactgagcagccccagctcctaaactgtggtgaaaccacctcctctagaaaggtgatggtaacttcctacttttgcaaagacctgccttcaccatttgctgtttgcctttttagcacttcccacttcttaagttccccatgttaaattctctcagtgaaaccacttggtctgggttcttttttcctgactgtactctgactgattcatttcgcttgtagtctccaattcaaaccaccagaaatgggatgatgaacaggggaaccaaaggagcacattgaccatttctgccccttcaattaaattatataagatgtataaaactattgtgttgctagtggtagacatagacatagaaaatatagttcataaggatcatataatgtaaagccacatataaacaaaataaaaatataaaatagtatagctgtaagttttagagttcagaggaaggagaggttggtgttaatagtaggtaatggaggagataagaccagagctgaactctaaaggatgaaaaaccaagtggtgaaaaagaacagccagcaagatgtgggggagaagggtggggcacaaggaaggaacaggatcgggcccggtgtgttcacggatggaagatggactgaagtgaaggcatggcagggagggtgtgtaaattgtttcagatagtcaaggaaaagtcacaccacagaggttcttcagtaacaggaagaaaaccatgaggtctctattcagaaaagctgaatggagagactgtccttagacgatgagggctgtagccccttcttcatctggttatgaaacacagaacaaggagtctgaaagccagattttcttcccattaaccactttgtaatcttaaaatccttagggtctcggttgcctaattgcagagtagtttataataagtaagagtcacctaaaaaaagttctttgttgctgtttttcaagttgctaagtattttaaagatatttactacacacctaatcttatactctaagattaagaggttagttttatttttgccaatgcccaatgtactttcataataaagatgactctaggttgcataagagtaaccagaaagaagggtatttttcctagtacctagttctagaacatgctgaattgagtgtaactctaacctcaaaaaactagagtagataaaatgaagtaatacttttcacacagtatattaattgctattaaaaagtgaaagcatacataacccctagaaagggcacgtcatttgaaacttgatgaattttttgataatgaaaatgaaaagcaacattaatgcaaaggttaaaaacaacgttagagtttctaagtgagttagtttgacaagtggctgatgaaataaaattctacatcccactttatattaaagtgaatttgttttgtcaggtgtattataattcacattagaaaagctagtaatcattttactgttacttccacctttattgtgggaagaacttggagaagcaatagcttagctcttatccaatgccaggaatgaattgcagtcggaacaaacaaaagacttaattttaacctttaagtgaaagcaggaatagcacacatgtaactgacatcttatccaagacagattttttaaaaagaacaagaaagagaataagagaagtgatgctaaccggaactttagcatctggaagaagaaatcaaacttaacttctaccattgtataaattaatattggtaaaaattaggtttacattttgagtctttgaaaggattttcaactgtctttgagtctgttttaacttccaccaaaactgtcagaatttcagtactgataataaaaagaattacagtagatatggtctatataatgttatgaaatgaagacatatgtgactcgagcatagtttgcaaaacatgtaatttcatctatggcttaagctgggggtaaggggcctttaatagaaagtaggtaaaaataaacctcttaacagaaggcgaatcaaaacttaccagggtcccataaccacgtcattcaataaaatgagcaggctgggaaatgaagaaaaattaatccaaagggcgttttcagttctgaataacaacatagcaaagcaagagcttaattgttgcacttccacaagatgatgatgatgctgagcagtctcctgagtttgacaagaatttcagtgaacccttaattgttaagtcattataacaactactgatgtgtcatccctactataattgctttaggctctttccagcacctgttttgcatttagtgttagcattaagagacttaacacacatgtaaaataagactattactctgtcagctgcatgtatacatttgttataaagcttttttaaaaacacacacacagccgggcgtggtggctcacgcctgtaatccccagcactttgggaggcagaggcgggtggatcaccagaagtcaggaggtggagaccagcctggccaacatgatgaaaccccatctctactaaaaatacaaaaattagctaggcgtggtggcgcatgcctgtaactccagctacttcggtggctgaagcaggagaatcacttgaacccaggaggcggaggttgcattgagctgagattgggccattgcactccagcctgggcgacagggtgagactctgcctcaaaaacaaaacaaaacaaaaaaacacacacacaacacaatggaataacctgcatcttttagtgttgtgcaaatgagatcgcctctttgagctctgaaggtcaaaaattataaaaggaaacacaacaacaaaattcatgcaatcaatccaagagcaattttacaaaaaccttgaaaaaagagaaaagccgtaattttcacatagccagtattctgagaaaagaggatttatttaccttggtagccactacatcctccacacctcctaaaatgcctgtgccccaacatcatttacgtggccaaagctgctttcagctcaacctcctggcccatgaaaaggctgagaagtcatagaaaatggagtcactggaaacagaagtgagccatgaccccacccagtctgctcttctcatagcacccttctgtaacgagcgggcaatttgtaaaaagaaagcccttgaaaatcacctgtttacgttccagttctttctctaaaaacaaccgtggtccttatctgaatagattgacactgaatttatgcagataatttacatgaatatttcaatctccattgatggaagtagaggtttatgggatctaacctcagagcctcatttgtcaaaacaaaaacagccattattgggagcctcagagtaatttattcccatcacagtattaaaaatatatgtatcaggatgcagctgtgagatcaaggtaccttcaggtcccctctcttgtcagtctctggaaggataagaaaatgtccccactctgatcactgagtcagtgtagaaccacagtcccccgggtgggttctgtgggatggtacttctgtgagaataacttaagttacactttagcaggagcggcctgtccgacctgcagcgttccgtcaatggcacactgggcagcagcttcatgttgatgccccagggtgggtatataactcatcctccacaagggagaggttttgaaatacttctgatatcaaaactacccagtagcaggctggcctcctcagccccagagctgtttatcttgttttagagatgatgtttccattctttctttaacatgaaagcacagtggatagatggaagttttgaaaacctgtaccagaaagatttatcaactagtccattttatcatcacttgagaagagttcagaaagtatgccttccaacatgaacaatctagaaaagaagagagttaaaataaactgctctctagaggtactacactaaagaaaaacataaagacctatagtggctattcaggacctactatttttggttttggtgacaaaaaataatttggaataatatcagtagctaaaatagtggatatgcagagactgcaaaatgaaaccacaacacagatacaatctgaaagtaaatgagctgtgactcttaaaaaattaaaaattctcatacccaaaaaatgcaatgctaagagagttctcaaattttttttctattcctactgtagtagataaaaggccgtgtatattttacagaaagagaaatccaactcacaggacacccagagagtaagagagttgtcaaagattacatagcaaggtcactcttgattttcagactctaaacacactgctctggccacattactgcactgttgtttcagaggtcattttacatgaaagcatgttctctttcattgccaaagaaaaagaagtaaaagatttcactagatatattggaccaggtttaggtattagaggaaaaacaaaatcactggtttgttgtggttgacttaatgccttacagcctcattttcttaacactacaagccaataaaatgttttactttgcactttcttggaagccagttgaaagtcggcagatggtttcccaatggcctatcaaggcactttttctgatctccaactttgtgatggatgtgatatagttttaaacccaaaaattttagggcaaactgtgaggttagaagaaagaaacaggtgttgagtgatacagagatacataggatcaagttacttgaaacaccattttcattttcaatttttttttttttttacttgaaagccaaggaaggggtttactccctacagcgaggatattttgaagatgaaaattcaaagttggggattttggactaaagttgtctctccatcatagaaaaagcatgagttttatggcttttgaagaagattaagcgagagatgggtctctgagaaaggcctgttagggatatgaattgttaggatagaatagtgcaagtgtagcaaatttctttactctctgtgaatggcatggaaggagatatacaattgtttttgtggaattaaaggcattctaaagatttatgactttttacattcattttaaggcattctgaagatttatgtctttttacattcattttaaggcattctaaagatttagaactgaaactgtaaaatatgagtcaggcaatgtctgctttttgcagctactgcagggtttgatttgcaaatgcatttgatttggagaaatggcactttgtaatttatccactggcataatagatgatccaacattcatttagtccctttccccatgctgctaacaaaatgcattatgatttagtaaaattacctggtatttggggcaggaaagggcctcgggagattaaaggtgagaaggggttatattgcagaatgatgtcttctaggaactaatcttgccctagggcaatacaaaatgagcaactggtgaaggcagttacagaatagctcatatttgcttttttcagctgagtccagtaatacttgatggttagcattaccagtacatacacacaactatattgcatttcccttggttttgctttcatcttatttaatattccttcataactttttacttaaaacacagcgtagagatgtaggaagaaaatcatgtgggtacataaataattcatgtgcacctgaaggcacaaaaatcatgctagacaaaaacaagtagtaagaaaggtgaacaagaagttaaatctaaatgttgttagacgggaaaaaacaccccagtgtaaatctaactgaaggagtctgaaatttaataaaaagtgacatggctctctcaatgagaatgtatgtaaccttaatctttggcccacatcagggcaattaaactaattcatcagggattgtcttgagtttgaataattttagtgtctagaagattgttaatcttaagatacagaactatcagctcaatataaagatttccaactccatttacagagtgttcttctttgccttctaagataattttctgaactatgcccacgcttcttaggagcatgccaatccacttgcagacttcagtggcagtagcagtatgtctccagactttagaattagaggttccagcactgactaaaagatagtaactactttttaaagataatatgtgtatttaaaacgtaaaacatactttcagggaaaacaattttaatagccttaggtttgatgaggctttacaaagcatttaaccatgttgtatatactttagagggatatttaatagattaatattcattagtttattttctcaatgtattgaagcaagtacaccaacagaaaaacaatgcacagtaacctaaaatctcaaagaaatgtaagtgcacaggtataaaaggcagcaaagctacctttttacatattagtgttatacttccttaggtatgtatttcctttaattctatatactgataaactaatgatactaataatggttaacatttaatactatgtcaggcactatgctgagtattttacaagatctatcccattttcccatttaatccccccaacaaccctatcagttaccaccaatgtataggtgagggaatgtagtacagatgagggaatctggataagaaacttgcacaataattaatgccactaatgacagaattatctgcaatccagatccactaaaatttctctctgacttcaatcattcttctttataatgaaagatacttgcagccaaggaaaaggagatcatttgcaagtgactgaaaggccacatccctatctagaattttcttctctgtaacggttaagattctctctctctctctctctctttctgtctcaagagatggtgactcactctgctgcccaggctggagtgcagtggtatgatcctagctcactatagcctggaactcttgggctcaagtgatcctcccacctctgcctcccaagtagctgagacaacaggcacagaccactatgcctggctatttttttttttttttggtagagatgggatctcactatgttgtccaggctggtcttgatcctggactcaagcaatcctcctgcctcgacctcccaaagtgctgggattataggcgtgagccaccatgcctggcctaggtttgtctcataattatccttggtttggggaataaagaataaaggaaacagtcactgcaagtccagaatcatttcagactcctcacaggactggaggttgaatggggcaccaattgcttggctggaaggaagtaaagaggagaaagggagagatggggcaaaggcagagaagacagtggtggagacagcagcagtgatgttacctggctctacgatttctctttactgatcagtagccagccctttatttaattttcctgtgctctgtccaggacaaaagtgtgcttcctagaaaacccttgatttattagaggagatgtattctaaaacaaaaattgaaagggtgtctatgaaagagattgtgggaagatgaaaagggcatttcctcccccaaaatgtagtaaaacacaggaggaaatttgaaaataaatataatatttatcttacacacacaacagaatcacattaaaattgccttaaaccattgtctatagtagggtaatctaatgattctaagatttcttgttaattgatgtccattcactttgagaaggattgaggaaagtaatagagcctctttattatactgcaaccttgctgatgatggaggtttgggattgtattttgatttttgagaatgtatgcatttctgaccaggtcttggaagctccaaaataatagggcagtcttcaaagaaaggcacttgtaaactctttggagaactattgagccttttatcttggaagtcagctctttatccacatgcaattagtctaaaatacaaatccttcctgagaaagttcatgtaaaagaaacagtatttctaacagatttgtctcatgctttttacttactataacatcatactggaagttggaagcaaagtcaggggtcatccaaataggagtttcttctaaaactccctaagaagtagtcatgtgctaaacaccatctgtggtagagaattctaccttcataagatagtcatttcttcattattctgaaatagagtctgtcccccttcattattccactcataggtaagagatcaacttcttggagcatcagaaatttctaatctctctgccacctagcagtccttttacatttgaagacaggtgtacatatagaagccctttctgtcttgctattttgcagagaaaataacatgggatttggggtcagtcctagattcaaaatccagctcaccataaagcacttacacaaacctagatacaatattaaatgtctctaagtctctgtttccttaatgagaaagcagagaaaataacaccatcccattttattgataaatggattaatgagttcatatatgcaaagtgccttacattagaggtgctggattaattgtggcctgtataatgactaattctgtggcttctgtttccctcgcccatcccagctggttttctactgacacaatagactacagcttctcaaactgggtgttacaagtgtgccaacatattattttctgtgagtgtcatggcattggggtgtgcatgagagaaagcattataatcattttatgttgtttcctgagtattacagattttttagaataaaaaagtctctctcctttgtcataaaaatattctctcattatcaacatttaaagagcaactaagagaaatttgttagttcttgacagcgtcttagtcccccagccctgagataagcaaagccttttttacccatttgtatcttacaaatattaccattttctggggtcaccaggatggaaaaagaaagttagaaacactgcactaaaatgtattaatatcagtctttcctgctgtgtggtactatatttaactaagtgttatactccaaaaaactaagagtagaatgaattatgttcttcatttatcctggatctgacacctccattattgcagcctaaaatggcatttgggttttaggagagccacatcagactgttaattcacattgaccttgcagttaatgagtacttttagcagaaatgcagattcattcatttaaaaaaatatgtatttttgaggtacttataatgtgcactattctaagcagtaaggatgtagtttctaacaatatcaacaagatttcttcctttataaaaataaaaataaaaatgcaattttaaataaagtcaaaggaatctacagtatcatttgaatgtctttttaaaaaggaataaaaggactcccaagttgctgccttggctaatttctgatcaggagaataaataccagagcccaaatgggataggaataactgctttaaaaaaataaactaggctaggcacggtggctcacccctataatcccagcaccttggaaggctgaggcgggcggatcacctgaggtcaggagttgaagaccagcctggccagcatggtgaaaccccgtctctaccaaaaatacaaaaaattagctggatgtggtggcgggcgcctgtaatcccagctactcgagaggctgaggcaggagaatcacttgaacccaggaggtggaggttgcagtgagccaggatcgtgccattgcactccagcctgggcaacaagagtgaaactccgtctctaaataaataaataaataaataaactaatatgtttcctgttcatttagtataaataaatgcagaaggacgcacaataggctgcctgacattctttcagccagtgtgtattgtaatatgcaacatctgtcctacttgagcaggcacgattttgtagtattcaaattaattgacacaatttgggatagctttctcatagcaactactagtggttctttcgataaagcaaagcagaattgagacagagaacctgtctttatttcactcttgattatgacgtctaaaaatcagatagatgcttgcatacttttgcacatggcattgtgacaggacacactaggttgtgacacagtgacaaaccccaaaatctcagcagcccaaaacacaaattttaactatttcttgctatgctgtatttcttttgcaagtcggaagcaggactttgcctttggtaattgttcagggatcttggctggccaagcaactgccatcttaaatgttattcatcacaaagccagagggaaaaacagatgcagtgaagcagatgctgtctcttaaagctttcactgtctctagacagagaaattaattgccacacctaattccaagtgcacagcaaagtacaatcctcccatgtgttgagaaagagagacagtctgggatttgtaaaccaccatatgatgaccagaggagcacaaattgtattctttcctcccaaattactatcagaattagaatgctaattggattcttccctcccaaagtaatactactttagggtcttctgaatcttactttgacaattattctaatatgactattggtgcaattttaatagtgcattaaatttaggaagttcttatattatctgtcagttgccatcataaatctggagtgtatgtattctctaattagatatttcacttttttaatgtcaaagaagtaaatcattttatccttttggaatagagtaatattgatgtaaagtactgacttaggtctctgagaggtataaataaatctggaatgatgtgggggcatttatggttttttaataaattaggatttaggaatttatcaactgtgggtggttttggttggcctgaatggtgacactggcagaatatttttgtgaactgttctgctttagtgttggatatggtactactggagtccttataaagtgaaacactgtctggaactcagtttgaaagaagtatctggctaatagtctgtttgggcatgtctttattttataaaaattctgttgcaaataaaattgtatttttttaatactgttcacctctaaagagtgtggctttgatcttcctttcctgaattcctacaggctttgtggctagtgcctgttttgtttgttgatgctctattgctcacacattggatagaagtgaatatttttctcttattctttgtttaatacagaaggctgcactgcgcactctcatctgttacttgaatgcatctcaaacagtctttcagaactcccacatgaggatgacaatgaaagtagtcagtaattgttgatgaaagctttgtaacttctgcatcatgtaacaatattgaattgttaagaacaaaagctagtcccttgacctcctttgcattctgagacggtttacaggaaattcaggtatggccaaggttttgttattcttccaacttagcaaatgcaatataagacagaacttgataaaaaattaacaagataatctgacaaactgaatatgtatatgaccagtaaatattctctcttactgataggtttggtgttatgtccctgagatattctagaactgaacttgttgaagaagatttactcatctttgcatttattattgcagtaaagtctccataaattatccattgtttattataaaatgtttattttttggaaggcctgagttataaacacttatttcttgggagcataaactgaatctaatggtttgttcagattatttattacctagcccatccattttgatacaactcacaaaaatactacagtgcaaaaaaagagaacaataattgagaaaattcaggatataaggaaaacattaatgagaaaaatgcagctatgacagccattaaaactgagaatcaaaaattgatactgcagccacatctctgatgctttgcattactaagattgcaccaaaacttcaaaaatcacgaagcttattaaatcacattgctcttcctttaattttaacaagaattaaaaattcttattaataatatatttaagagcaaacatgtttttgttcttgaataaataatgtaaaataattattatatctttattatagtcttttaaatattttaattatgagtaatatggtatcaaggtagtacctgtgtataataaatacctctggaggctactgatagcagagagcacaactctagggaaagcctgactattaacttttgttctaaatagtgagggtaggggcatgaatagatttatattttggtgactgtgaggaagatgaatccaaggggtaagaccagttagacagtgacagtaataccccagattagaaataataaggacatggggcaaagaacaaatacaaaaggaaagtgggggcaagttcaagaaatatttaagggggaaatcaatgatttaatagatataacaattgtcttcattttgcaaattgtatccaggccaacttcccaacgtgtagactccatacacatttctaaaatattttgtcatgagatacatcacacatgcaaagggtttagagtatatatatgcacaacttaaagaataacaataacacgaacaaccttgcttttctaccttgcttcaacttaagacagggaatattatgagaaacttagaagcccctggcggcccctcaccagtcagagctgcctttcttcttctagagctaaccactatgctgaaacttgtattaagcattcttttgctttccttaggattttaccatttgtattatatataaaaaaggtatctctaaacaacatatcgcttaattttgcctgcttttatgtatctattaatatacaaaattgatatacaaatacaaccatgttttgatataccaattaatgatataccagcacaactatattttgtgtattactgtgatacatttcttttgttttgccttaggtttgtgagccatctgtgttgacatatgtgattgtagtggaataatatttgttacttaataccttccagtgtatgattatacaacagattatatatccatcctcctgttgatgagtgcttctaactttctgctattaagcataacaccctatctaccagttaagactggttgtaacaaaataaagaagaatgctgccacatgctgtggtgcatgcctgtagtcccagctactgggaggctgaggcaggaagatctcttaagcccaggagttctgcactgtagtgcgctatgccaatcaggtgtttgcaccaagttcagcatcagtatggtgacctccagggagtggaggaccaccaggttgcctaaggcggagtgaaccagcccaggtcggaaacagagcacgtcaaaacttccgtgctgatccgtactgggatcacgcctgtgaacagccactgcactccagcctgggtgatatggtttggctgtgtccccacccaaatctcattttaaattgtggttcccacaatccccatgtgtcatggagggaccccatgggaggtaactgaatcacggtggaggttaccttcatgctgttctcatgatagtgagttctcaccagatctgatggttttataagaagctttctccttatttgctcagcacttctccttgctgctgcaatgtgaagaaggctgtgtttgcttccccttctgccatgattgtaagtttcctgaggcctccctaaccatgctgaactctgagtcaattaaacctctttcctttaaaattacccagtcccacgtatgtctttactagcagcgtgagaacagactaattcactggacaatatagtgagccttgtctctaaaaaaaattcttgggaagctgaggcaggcagatcacttgaggccagggctttgagatcagcctggccaacatggcaaaatcctgtctctactgaaaatacaaaaattagccaggtgtgttggcacgggtttgtaatcccagctactcaggaggctgagatatgagaatcacttgaacctgggaggtataggttgtagtgagctgagatcatgccactgcactccagcctgggtgacagagcaagactctgtcttaaaaaaaaaaaaaaaaaaaaaaaagccctattaacattcttcaacatgtctcctattcaatttgtgcaagatacagtacacctaaatgtgaaattattgtgtcacgggttatgcatatatactactttactaggcaatgcaaaatttctctacaaagggaatgtactagcttccacctctgtcagtaatgacagttccccttgcttaatatcctcaataacacttagtgttataagagttttctaggctgggcgcggtggctcacgtctgtaatctcagcactttgggaggccaagatgggtggactgcctgaggttgggagttcaagaccagcctggccaacatcgtgaaaccccgtctctactaaaaatacaaaaattagctgggcatggtggcgggcgcctgtaatcccaattactcgggaggctgaggcaggagaattgcttgaacctgggaggcagaggttgcagtaagccgaagtcacgccactgcactccagcctgggagacagagcgagaatctgtctcaaaaaaaagacttttccttgttttttgttgacataattattatatcattgtcttttatttgcatctcgttgattactgtgtggctcagcactttttccaaggtttatggccatttgtattacttctccgaaatgtcttttcatatcttttgtccatttttttttttactgggttacatgtatttgtgagaattctttctattctagatagtaatccattgtcagttatatgcattacaaatgtctatttctagtttatcttttcacattcattaagctgtattttgtttacttcataacgtaatcaaattttctaatatttttcttttcatccgtttcacacaagaaataacccaaatcaactccttcagttttacttgatgatatttctatttgttcattcacatataaatattaatgtatgtataatatggaaaatagcctttacatgttaagagggaaaaaaatgacatactatcttacccttcacaataaccatgctattatactgaccactcattacataatttaccagaaaattatgcagaagtagcataagtctttccaacattaatgcaaagacattatcactgattttgattttgagatgtggtctcaggtaaagtgataattgtattaaaactaatctttttttcaaatgcattccaagatctcaattttctccctcaaatattaccataaaaactgatgtcttagcccacacaatcctttctatcaaattcctcacaaccaggctttggatagagggaatttctaagccctgctgtggccgtctccacctgctcttccacgccattcctccttcttccatgcgcacacttatatctctaagaacctatctcacgaatcaatattctacctctgttagctcaactctccgagtcattctagttgaggaaaaaagagtgggaaagtaaaattaccactgtggtcaagattaagacaacttaaaccagaagctgaattccaacctctgtgaagcatgaagaacaccgagaaacacaggctgctaggaattactgccttgactctaccttgagatttcagcctttccagttcccttatatctagtaaagcatcattaatttggggcttcactaattcaaaaattgttaagagttcacacaggtactctgttgaagtttaattttacactaagaataatgacagattgcaaacaatactagtagcattaggaggatattcactataaaaaaccttatcttcacaatacatataaagaggatagtcacaaaaaatgtatcttcataatatataagggggatagtcacaaaaaaagatcttcaagtactgcaaaagaacttgtttgtttacaatattatgcttaaaatatatgttacagtccctctcaggaaattctaagcagtcattacattattacacattgctagaaggaaatgatagttttcagactaatttgaagtagcttttctcccaaagatttccaaaatattttttaataaacacaaacacattgcaatactgtttagtgcatttaataaaatggaaaatagtacactagtactgtgattatactttagtttcaagagataattgttaatatacatgtatatattttagatagggtctcactctgttgctcaggctggattgagatggtatgattttgactcactgcagcctggcctcccaggctcaattgatcctcccacctcagcttcccaagtagctgggactacaggcacacacgaccatgcctggctaatttttgtattttttgtagagacagggttttgtcatgttgcccaggttggcctcaaactcctgagttaaagcaatccaaccgccttggcctcccaaactgattattaattttaaaatgtccgttggtaaccactcttaacatattttacccgtagagaatttttctgaagaaaaataattaacatagaaacagaaatgtcaaaatttgtctaattatctaatttactcattactgacccatactggttttattgattttatttatatgctatgtgttttaattatctattgtataataaattaccccaaaacttagcagcttaaaacaacaaacatgtattatcttacatggtttctgagagttagttctctgggggtggctaagctgggtggcgctggcttggctgtcattgcagctgttgtctcgactgaaggctgagggaggatccacttccaggctttctccatggttgttggcaggcctcagttacttgcctgagttctcaggctggagtcctcagttccttagcaaatgagactccagaggctgtttgagtgtcctctcatatgacagtttgcttccccacagcaaatgatccaagagagaaagagtgtgactgcctacgatggaagccatggtcttgatgacctaacaacataccatatgacatatcatcacttctgctcagttctactgctcgcatagaccaaccctggcacaaagtgggaagggacttcacaagcatgtggataccaagacacagggtgtgaataccaggaggcggagatcactgggatccattttggggctttgctaacacactatgattttttaaaagaagaatacaaaaaaaagggaagaaaacacaatatgggggaaggaaatgttcactcagaaggtccagaaacacattcaaatatatataaaaatactgtatactaaagaatggtctctatatatttgagtatgtttctgggctttatttttattttatttatttatttatttatttttgagacggagtctcactctgtcgcccaggctggagtgcaatggcacgatctcggctcactgcaacctccgcctctgggttcaagcaattcccctgcctcagcctcccgagcagctgggattacaggcgaacacaaccacacctggctaattttttgtattttagtagagaggggtttcaccgtgttgcccaggctggtcttgaactcctgagctcaggcaatccacccaccttggactcccaaaatgctaggattacaggcgtgagccactgtgcccaggctttatttttattttttgagatagggtctcactctatcacacaggctggagtgcaatggtgcagtcacagatcactatagccttgacctcccatgctcaagtaaccctcccacctcagcctcctgagtagctggcactacagacaatgtgccacctcacctggtgaattttttgagacagtctccctctgtcacctaggctggagtgcaatggtgcgatctcggctcactgcaacctccacctccctaattcaagcaattctcttgcctcagcctcccaagtacctgggactacaggcgtgcaccaccgcgcccagctaatttttgtgtttttagtagagatgggatttcaccatgttggccaggctggtctcaaactcctgaccttgtgattcacccccttggccttacaggcgtgagccactgcaccgggccatctggtgaattttttaaatcttttgtagagacaaggtctctctatgttgcccaggctggccttgagcaatccatgtgctcaggtgatcaagtgatctcactatgttgcccaactcctggtctcaagtgatctgccttggtctcaaagtgctgggattacaggtataagccaccatgcccaactcatttctgggctatttcagtccattgatctggctattacagcatcaccattatactggttttgattattatattattaaaacgtagtatctggtagaagaaaaagagaagaaaattttaatttttaacaataacaaaagtgtaatttaaaaaaaaaactttgcaacagctttttttgtttgtttgtttgagatggagtcttgctctgttgcccaggctggagtgcagtggtgtgatctcggctcactgcaacccctacctcccaggttcaagcgattctcctgcctcagcctcccaagtagctgggatacaggcatgcaccaccatgcctggctaatttttgtatttttagtagagatggggttttaccatgttgccaggctggtctcgaactcctgacctcaagtgatccgcctgcctcggcctcccaaagtgctggggttacaggcatgagccactgcacccggcctttataacagttttatgctcaaataatcaattctgttctcctctttttgccaaattcattaatttcaaaaaagtggttatcaacaatttctgaaaaaaatcatttattaaatttggaaatggaatgcaggataataatgctcaataatcaaggggaaaatgttgtgaatggaataaatgaactattggatcccaggggccagtcgagaaatatgtcaggggaaatgtgatacagatatacagaatttgcttgaagaaaaaaatggatggtagcgaggtactcaaccacgttggatccctgatatattggtttggtaactttttgtttatgtctggcacttctatcatagggtattactattaccatattcacctccacagggagttatatggaattagtggcaaactataaagcgaagatatctgctttctcattctcctacccaccatcttcctttaccaactgtatcatttatcacgtattaactgcaatgataaaaactaaagcatctgggtataatgcaaaataggttaatttcttgctcaagtcacagtccaatgcaagtttagtgggaggaagagaggtaaaactattctgcacacgccctcagcatgcctttcccatccccctagacctcagcctttccctgaattctgtgcatagtatgggcagataagacagaacttggctgggcatggtgactcatgcctgtaatcccagcactttgggaggccaaggcgggtggatcacctgaggtcaggaccagcctggccaacatggtgagaccctatctgtactaaaaatataaaaactagctgggcgtggtgatgggcgcctgtaatcccagctacttgggaggctgaggcaggagaattgcttgaacccaggagatggaggttgcagtgagccgacacggtgccactgcccggcagcctcggtgacagagtgagactccatctcaaaaaaaaaaaaaaaaaaaatgacagaactttgtggactatgcaagatgaattttagggaccaggcctgcaagtgttgcacatcatttccattagttagaactcagtgacgggaccccaccaagggcatttgggaaatgtactaaagctgtgtgtccagaaaaaaaaaaagatgggagtttggtgaacatgcagtatctctatatattgccccattagtctacctggaggatgagtgtgggctctgatgagaatgttaaatcccaataactagtccttcaatgtatacttttcttgtattttatgctttgaaacagttatccttcaaatttatagaaataagagacttcactgaatcttaaagctacctaataagctctgagcttggtggtagacaataggctcagaatgaagggaaaggactcgtttggagcttctgtgagttattgagagaggttgtgctattattaaaatcacttgtgctcacattctgagtgttcaataaatgcaagtttatggcaactctaaatggcaaagttcctcttttgatgttctgatccaaaagtatgagaatgtatatttaaaatgatgtagagtttttttttaattgtctacttgccctaggcaggtgtgaattcttattcatagcaccttctctgtgcaattgacatttttaaaacctatcaagtaaatcttcactttaaaatttacatatgtaattctatgaattcaacagtcacttgagactatttgaagaaaagagaaatgtaatgaaaaattctgatttctaatgctgagatttaaaaattaaagaagcaaaataagtctcaagcctcaaaaccaacagattagaactgctattttccctaacccttgattgatttactttggttattaagcattaaatgacttatgaaatcagacatcacttatttctttgcaatcatttatctaattgacctatttctaggcaagagacataattctagtcacttggtaggctttatatgggcaattggtggctgaaattttatttctggctcaattaaggaatttaaatacactatttcctcttgataacgtatctaatttaggatcttctcaatcattaggttatgtcataggattttatttagattgcattaactattaaccttctgttttcccaaacttggttaaaaataattctgatttgttgtacaattctacctatatttcactttgccttatctctgtgctcccaaattgctgcttcccaaattttccttcttttattatacatgtaccataaaaagcttcagaggtagctatgttaatccttccttcctcccttccttccttccttcctttccttccttccatctttttttttttaaacagaaaaattcaccacagtgaatcatggcagtaatcttccttgataagttcataatgtgagccattgtagcatcaaattaaagatacctagaaaagcagtgtttttaggcaattctaatcaaagagagtatttgaaaatactaataaagtatgaccttcaattttttgttaaaagtattagtgagaagaatggttaagaaaaagaaacaccttctgtaactattcattatgccatcagattctccaagctctaagtgctctaagggcaggattctgtatcctcacagtctgatacaactagtcactcaatacttactgaatacatttatcaataaaatcttatgtgaatggtaacagttatgactcatttgcatattttgaataaaagcggaaacctttccatgttgatatatgaaaaattgtgtatagcatttaagaagcaagctatacaaatgcttttaatactatgaatgaagtctgttttttgaaaaaagcaatggacattcttagaaagttttctgggatctagtctattggttgattttctttaacctgtgctgacagaaaactgcctaatcacactgaaaatgtctccttctgattaaaagtttcatttttggaatgcaatttgctacctgttccttttctgattaccaaaagactaattctccaaacaagaaatggttcatgactcttataactttattagacaaataaatgttctatttagaacatttcagaagaaaacagaaatgtgttggatttcaagcattttatttaaaattgtgtcaataaaaatgcaggaaatgggctgggtgcagtggctcacacctgtaatcccagcactttgggaggccaaggcaggtggatcacctgaggtcaggagttcgagtccaggctagccaacatggcgaaaccccgtctctactaaaaataacaaaaattagctgggcatggtggtgggcgcctgtaatcccagcgactcaggaggctgaggcaggagaatcgcttgaacccaggaggcagaggttgcagtgagccaacatcgcaccatagcactccagcctgggcaacaagagcggaactctgtctcaaaaaaaaaaaaaaaaaaaaaaaaaaaaaaagcaggaaatgcattattctcatttttgcagtatgatggaatggaataaattaaacaggtttacaaagttgcccacattactttaacatcttctaacatttttatagcacatcccaccgtaatatatttattgttatagttcccacttgtttgcaagcttctcagaggcaaggaacaatgtcctcaatttgtatcactggtacaacgcctagcacataatatgcacttatatttttgagcaaaaattaatttggtacctgtactataaaaccgaaattagttctaagtctttaaaaaataacattaaaaaccaaaaattctcttattgttggatataaccctgagatcaacttggttgtttattaaaacattaagcagtgtgcataatacctgtttgtagacaggcctagttgcttattttgttgtgtcctactttcagcgagattactgtaaacgaggcccacaacttcatttataatcaccacaactctaagtgtgtaacaggcaagcactcaataaatattaacttgtacgttgaatgttcaacagtgcttagcacaatgtggtacatgcccttgaatataccagatattcagtaaacatacattaaataaatcgaagaatagcatccagtaagagagcactggcttctctttccccagtctacttttaggaaaacagatatatgtgcattcttaacagtatcagataggatgaggcaagggactctaaactgaactctgtatattctggtgtgttaagctaatcctggtgctctctgtagctctccacacatagtcacctgatagtctgtttttctcccctgcccactgtctttaggattgcctcgaaaaccctgggtttagctactgcctaccctggaatactcactccagccatccggatttcttcctatcactgtaactcatctcaggcattctgcacattctcctttccactctatccccttgcttgggtaatatctgtgcatctgccagtgtcctcttgaatggctcttgttccaggaagcctttctggatccactagagtagattagatatcactaggtgcctccagcatccagtgctgaatcataaatatctcttatcatagcattcatcatataatttaatgtctgccttccctatggacctataaactttgtggaaagcagagaattcttctatcttgtctatcatcatatctctagcacccatgttcaatttatagttaatgaaatccaacaaactaatcatgtcttcaacttgaaataggaggctcagtagagtaaagggaactctagagtgggagtctgcagaaatgggtttaaatcctattactactacggtgtggccatttgctttgactctagtccctttcttcccctacaaagcaagttaaatagcataatttagtttgctcatatcacagtttgtgaagctaagaaatacaaacactattgtaaattgaagagggacactttggtaccctagagaaaaactgctgtccgcacaatggggctgaaaaggccaacagttgaacaacagccttttccatggagcctgtccctggctgtgcagttggaactgcttgcagtgtagttggctgggtctgcctctttgcctcgctcggatgcaccaacctggtgattcctccagcctgctcaccaaagggggccgagggacacatcgcctattgtctccctggcagtttatgcaagacagaatcatttatataattttatttatgaactccaggcattataccttggcgtcaaaacaatggaaatgtacatttgtaggtctcaatgattcccatttaaagtccaacgagctcagtcaaaacaggctaaattcacgatcttttatttataacttatatccaacgtcataaaagatgaggctgtgtagggtaatatacacatgaaaccagctgtttagataatatatgaagacactgttggagagggagaacggcatgccaggacatgtgatcactgcagctctgtaaggtagaggttggggctccggcatgggggcgaacggaacatttattatgggcctaaagacagagtgtctcattcctctattttcttgttctttctctttatcttgtggatgtgcaaatatttgtatttcataaaaggggaaaaatcaattcatagttcctcactaacaggacaatacagaagatggacattttttcttaggtatcctttctaattattcattttttttgttcaataattaaaatacacccataaattgaatcgcatgatggaatgactaggtataatagaaagtcagtcacacctcattcgtaatagtaataaatagctcagcccatgtgttcatagccatcagtatgtagggaagggcttattccaaaagtctgtgctccacaagaatgctaatgttcgtttatcagctgttgttttacaagattctgcatggactttgcaggtggggtttgtgctgaaggtttttatttgtcttaaaaacacaggaaaaataaaattatatagattttccacgttaacctatctagtgtaacttattaattcatttggtttaataactacttgggtatgaatcacaattattagattgctgacttcacccagtcttgccttgctcccaatcatttcttaatacttagcattaagaaaatgagacacttaatcataataaccacaaagtcagaaataacctagaaacaacatccatattttcagacatcccataaatcccaaacaggtctctattgtaaggatttcccccgatcaattctataagttcctttgtattttttaagtgtcttaaaacctaaagtttgcctattctttatcatctaaaaaaaaaaaccttcattcaaagtgtaaaattaatgattaatcttcttttagttacttatcttctctgagaagaggattatgatctcaagaaacggtagttacctctctattttactcacttgagcaaggtacacaccaaagcaatctacttttaaaatgttccctaattaaccaacttattaagttttgccatagaaacattttatgtcacatcagtgaacttccactaaaaatggggtggtgggagagagatagagtattaattgttaaaaaaaaaaaaaaagcaaactggcatgcttaagaaaaaatcagcccatacagcacctgttaaagcattcactttttggtgaatatgcacatatatatgcgcatatataaacatgaatgcacatatataaacatgaatgcgcacatataaacatatgcgtgtatatatacactatatatgcacatatataaacataaatatgcacatatataatgcacacatataaacataaacgattaaactagatcataaatcataaaaactagatgccagctgggcaaaacatatgatgttcatggtccccaaacacatacaagtttgaacctaaaacattaagtagggaagtacaatatattataagtcagttaatcctaaagtgtggtaaaccgggggtaaaaagatgattaagtaggctgggtgaggcggctcacacctataatcccagcactttggagggctgagggaggtggatcacctgaggtcaggagttcgagaccagcctgaccaacatggtgaaaccccgtctctactaaaaatacaaaacttagctgggcatggtggtgggcgcatatagtcccagctacttgggaggctaaagcaggagtatcgcttgaactcaggagacggagcttgcagtgagccaagatcacaccactcactccagcctgagtgacagagcgagactccatctcaaaaaaaaaaaaaaaaagatgattaagtagatagaacacaaacatttaaaattttgataattacacatttatattttaatatgtgtagaaaaaatacactgctgtgatgttattggtattgctgtttaatacaatgctaaatttaggtttataaaaagtaagtaattttaatgaaaaatatgaaagcaataggatattgctagtttaggtaggactgaaaatagtatacatagtaccaatatgaataaagttcgggaatcattaacacaggtaactcactagtattaatgccacacttatggtataatttaagtgttacaaaactgaaatcaaggtaatcatatgaagaagaaagtatgataatttggttcatcggttatcacattttatatggtgtcactagggaaataactttcctaacactttgttcttaggctatttacacttaattaccctattcaatggtacaatgattcaatcagtgaatatttattaagcgtctactaggaggacaaggtcctctaataggtaattttagggaatagagaaatatttttaaaaacacaccattgtctttaaaaatttttttggtaatgctcattttgaaaagtaataatttcactgttaataatgtaggtacagaaaaacattaggaatattaccagcaatcctactattcagatatagatcaaaatgttaatgggttatttttttaaagttgtttgaaaaatgaaaatatacagatttcttttattaacagaattagaaccagagtgtgtttagctttgtatcatgttttcttctccacttaatggcctattgtttcctttactaaatattttttaaaacataaaggaacagatatactgtttaatgattcatctaccaataggcatgtggctgagttctggcgcatacaatttgggcagaaggcacatttcctgcctctaggactgactctttaaacacttcctaggccgggcgcggtggctcatgcctgtaatcccagcactttgggaggccaaggggggcggattgcctgagcccaggagttcaagaacagcctgggcaacatggtgaagccccgtctccactaaaatacaaaaaattagccgggcatggcagtgggcgcctgtagtcccagctactttggaggctgaggcaggagaattgcttgaacccgaggggtggaggttgcagtgagctgagattgcgccactgcactccagcctggatgacagagcgaaactccgtctcaaaataatgataataataataataataataataataataataataataataacacttcctagtgatcctgcaagtgctctttttcaccttccactgccagctagttgcaaagcatcagtgaaggcctttgacatcccaggagatagcagatctaccaaatggagagagtcccttccccacccctcagcaaacccacagagagaaatgggctgtgctgtgatgaatttttattgcattaagcccctgaaattttggagtcatcacagcaactattcatttatgttcttcttccaagtcttaaaaacttccaatcctctgttcccttgttttgcagcactttttctatgggcctgattttgattttttttttcttttaatctcaaatgaagacgtctatctagtggtctccccgctgagtgaatatacttgatttcacttactaccacttctcaaatccaaggtaggagagtaggttgccatgtacatcacctaagacaatttttaatgaaacatttatctaatatgatcctacagaatgtcctctttctctgccatctatctagttttctaacatttggtatcaaaaagtccatgaaaagctataatcttcttgatgttctccaaccaggacactgacgctgtactttagtgctttatttgagatgatacttttcaggatgcaatgaatgactacctctacgggtgaaccactaaaggcttttgctccaagagtgatatgattgaacttatattttagaaaaataattctggtagtgctagaaattatggttttaagaaacaggatcctagaaggtgggaaaatgatgaaggaaacagcaagggaccctgaatcacagcagtgagaatagatgcaaaagtaaataccaatgatagaatggtcttgacttgataacaactaaatctgggagggaaaagtggaggaaactatggaagatgtcagaaatttcttgttcaagtgtcaatggctaaatcaggaacctacaaagaacaggtgactcggtggggaaataaacaaattccattctggaaatgctgacttcgaagtgctaatggaacatccactgagaaatgtcctgtaggtttaatgctcagaaaacaacccgtgccaaaagtttaggtgtggggattattaacataagttgaagccttgtgaatgggttagtccaggaagagattaaaaattgaggaaaagaaaaagaactagaacggactgaattctaaatgatgccttgtttttagagatagtagaattagggaaagagacagaaagaatggatagaaagagaaagaacctggagcccagaaatcaagagatgagacaatttcaatgataattccaatatgcaatttaacccatttagtaattaaaaatttttttaattttattttttatttctggaaattaggtcttttctcaattttactcatattttcaggcctcttttttcacttcttgaaatgtattaaacatacttattttacgttctatgtctgataactgcaactgctaattttttatgcatcatatttcacagtttatggattttgctggctctcccttatggcatcttgagtgttcagtgattgtcaaccgtgagtaactcattgttttagagaccacatgaacaaaacatttttcaaagcatgaggtgaaggggttcttgcaaaaaggatttgtatttgcttttcagacgcctgtgccattattggcctggaaccactttaaacttattgtacgttttaaaataactaagagtataattgaaatgtttataacacaaagaaatgataaatacttgaggtgatggataccccatttaccctgatatgattattacaacactgtactcatgtatcaaaatatctcatgtaccatatatatatgtgtggtatatatatatgtggtatatatatatatatgtggtgtatatatatgtggtgtatatatatgtggtgtatacacacacacacgcacacacacacacacacatacctactatgtacctgtatacataaaaaattaaaaataaaagaataggctgggtacagtggctcatgcctgtaatcccagcactttgggaggccgaggcagggaaacacctgagctcatgagttcaagaccagcttgggcaacatggcaaaacctcatctctccaaaatatacaaaaattagccaggtgtggtggtgaatgcctatagtcccagctacttgggaggctgaggtgggaggatcacctgagacagggagatccaggctgcagtgagctgtaatcgcaccatcgcactccaggctgggtaacagagtgagaacccatctcaaaaaaaaaattaaaaaataaaatgatagaaaaagaaacaaacaaccatctccccccaaaattattgctttaaagttcttctagccatccagatagcatgaattcctgacatgtgggccaatttatgattatgaatttcttagatgatggagtgaatacgtgtagagggagatttctcttcaaaagttgagggaatgagttaattttagttctctctcaccttggggatacagcccttttggaatcctggttttggcagacctatctgcttttccattttggggagggccctcaatttgttttttgttcccaaactcacaaactgagaatatatatgatactcaggttcctcagttctggccaaagcccttaaactaaaagccagcttcagtgctcagcttccctgccttatcagtctttgaccttagcattctttattttcttgttaccaatggatgcatttaattttttttttgagacagagtctcgctctgctctgccacccaggctggagtgcaggggcgtgatctcggctcactgccacctctgcgtcctggattcaagcaattctcctgcctcagcctcccaagtagctgggattacaagtgcacgccaccgtgcccagcttatgtttgtatttttagtagagatgggtttcaccatgttggccaggctggtcttgaactcctgaccttgtgatccacctgcctcggcctcccaaagtgttgggattacaggtgtaagccaccgcgcccagcctatattttcaaaggcaacaacctgtatttagaaattaaatctcctatgcaacactggcagtttaggggccaggacaactgatctcacaaaaacaactaaaaatgccaggtaaaatatttttaaatctttttaaggccgggtgcaatggctcatgcctgtaatcccagcattttgggaggccgaggtgggcagatcatgaggtcaggagttcgagaccagcctggccaaaatggtgaaaccccgcctctactaaaaatacaaaattagccgggcatgatggagcatgcctgtaatcccagctacttgggaggctgaggcaggagaatcacttgaacccggaaggcagaggttgcagtgagctgagatcgcgccattgcactccagcctgggtgacaatagtgaaattccatctcaaaaaaaaaaaaaggaaaagaaaatattatattatttgatacatgaaaatctaaacaaagatgtttaacaaaatgccaactaatcgcttgcacagtttatttaaataatgtgtgatgccagagcatttcgagtttgctttacatgttattaatttaactacttatagagagccaggaaccaaaacaacaagcctaattagttggaatcataatagctgaagaataatcaaaatatatccccattctgacatattctacccacctctactgttacaaacctactctatgctatcacaatggcctcctaactgatacttgcttttatctttttcttttccaaaccaaacccagaagccagaggctgtgatcctatttagatgtaagttagatgacaccacctctgcaccaaactctccgatggcttcccctgtcactctaaataagtgccacagtctttactatgatctaatgctctcccttcactttcttagctacagctgtccttatgtccttgcttttcctcaaacaagcaggaacattcttgcctcaaggcctcacatttgctgctccttgtgcttggagccatctcccttcagatacccatttggctgtgccctcatctccaggtcttgttcacatattatcttctcagactgtgtaaaatggaatcctcccctcacccctctccagcattccacattccatttccctggcttatttctctccattgcatttatcttctaacatgctatctaaatgaatgagttaatctttgtatactcttagaataaggcttggcacatggtgatacagcagtttattcaataacagtatgtaataatatacatatttggcttattgtctgactctatggggacaaggattttggcttttagtttactgctgtatttccagcatctagaacaatgaatagcacgtgacacaagctcaaaaaatgttgaatagaaatatctaaaaatatacaagaaaagattatacaaaaggatgccatttgttaaaaataattttatatggtttgaaaaaagaagttatcccacaaaaccaagtcctcaaagatcactctccaaaaaagaaatgtaattaaaattcaaatttcataactctttgcagtatgataaaaggtacatttacctaaatggcagtattttgagctcccctgaagatcagcactcttagctcacaactctgttgtggctctccaaatagtcatttaatacagagccacatgttcaaataaaagagaaaatgtacttgtcattgttcagttgttacaaactaaagaaaggatgaaatttctggacattagcaagatggcatagttgggaagtaaaaggtttggaattaacagatctctagtccctgtccagcctcttaattcctggatcatttgggagaatctctcgcatcatctctctgtagtctgaacctcagttcctttatttgtgtgtaactgtttatgtctcaaatgcctaaaaaggcttgaagacatactccattactaaaataacccaattttatacaaattaatcaaaaaacgttcagaagatagtcaagcacaggaatgtcccctcctctccgacttttttctcctgtccacacatcttcacacacctccagggatcctgcttatccagctatgcccaatgtggtttagccaaacctctcattttacatatggcagcatgggttatctggccttttcactgacatagtttctttctattccacccctgttgtgtctaagttatgctctaagagataatcagtattaacaagagagaggctagtttgtcttataggttcccacaataaagaatgtcaggttctaggcatagctagataatcaggatctctggaaggatgtgataacagattgataactgtctgaaactagtctgcttgctggtggagaggtttatgtgcacagactgtaagacgacttacagtaataccttgataaataccagttttgaagactttcaggtcatttaactaaccacactgctgagaacctgagtctttcttcagtgcatttcataccctagttttaagaaatttgagcattttaaaggaaattagaaatttgagtctagccaaatctcttaatctgcatatagcagggcaggttctctagccctttcactgacagagttcctttccattccacccattatttagaagttatgctctaagagattatcaatagtaacagagagaggccagtttgtcttataggtactgggttcccacatgaaagatatgaggttgtgggcaatgcattttcccttcagtgagccaacaggcagtttcaaatagctatcagtttattatctaggaattacagtactctttttggtcaggtaaaatgtagaatactgtacccttcttccccaacacccaaataaaggcaaaaccatctacctataaaatgcttctgcaaatcatttagatattatcatattttaagagctattaaagaatgcttcttaaataagaagactaccgaattatagaagtccaaaaacagtaccaaattatgaagaggtggtgttccacactgtgaaatctgagggcttttaaattagtatttttacttatgcaactcctttttccccacgcttaacagtgaacacaggaaatatattttcacttgttcagtctcttaatactgagcatctcttctgtgccaagcatggtcaacatctagagacacaatgccaaattcgaacatggtccttgcccttaaggaacttggtctaggccaggcgcggtggctcatgcctgtaatcccagcactttgggaggccaaggcgggcggatcatgagttcaagagattgagaccatcctggccaacacggtgaaacaccatctccactgaaaatacaaaaattagatgggtggtggcgcatgcctatagtcccagctactcgggaggctgaggcaggagaatcgcttgaacccgggaggtagaggttgcagtgagctgagatggggccactgcactccagcctggcaacagagcaagactacgtctaaaaaaaaaaaagaaaagaaaagaaaagaaaagaaaagaaaagaaacttggtctatatgctctgagggagaacttacagggtgctttgagagcatgaaggagggtcttctaacctagcagtgggatcggggactgaagacaattagaggtttctgaaagaactgatgtataaattgaaatctgaaggattatcagggagttcatgggagaggggttggtgtaagaaccacagagtgttctaagcgagagaataacacacacaaggtctagaagtgagagggaagttagcctatttcagaaatggagagaaaatcaacatggctatagtttaagttgcaaaagaggggataactgaccagccatggggctgcagaggtaagcagaggcaagctcacaaaggctttgtaataaatggaggaatttgggcttaaatataagagcaatgggaagctgttgaagaggttttaaacaagagtggtaagagacaaaatccgtttcaatcacctcttaaataaatggttagatcagaagagcacttctgaattatgggagtccaaaaacagtaccaaattatgaagaggtagtgttctacgatgtgaaatctgagggcttttacataaatatttttgctttccaaacactgtaggagacccttaacctcattaaatggaagcccttgacaacagtcctttattccagatgagcacaactcaggaattatccatctcaagcttatgatagaaatagtaccccatgtcagaaaaaaagtacaaaggcaggattttacctcatagtattccacatgaaagcacaaattagtctcaatcacacatcggcatcataggaaaatctcagaatttcagtattggaaagaatgttaaagatcatttggtccaacaccttcattttacagatgaaggcagtatacagattatttcttatacaagactgtggattctgccttgggctctctctccctcagatctttcatgaaggggggaagtcagcttggcatgtcatgagtagccctgtggagaagcccaggtgacaaggaactgaagcctcccaccgcctgccagtgaggaactgaggcctgcctgctggccatgtgggtgaacttgacagcaaattctccaggcccagttggttatgatagtggtcccagctgatagtttggtaagaacctcatgagagaccctgagccagaccaccttgttaagccactcttagattcctgacttcaggaactgtgtgaagtaaatgtttgttgtttgaaagtgctaaactttggagtcatttgttaagcagtaagaggtaactaatgaacagtacacaaaattaataaattcttaacaaacttacactatgcttcccttgatatctaaatagtagttattttctaaacaataaaatgtatcttcctttaaagatactaccaattgtgctcttcttctttgaaaagaggtgattaaatggcttatagaataggtgataggatatttagtcatttagaggtcactgactctaatttaacctgagttcttggcaaccacacatagataatactgaaatttgtttgcaaataattccctatggctacatattcccattttaatgtagctgttttttttaaatctccgtacatacaaaaatatgaacttaaattaaaattaccctttcttcttagttctaagcagccttagtaggatgctgagtaagggggaaacaacagcctatcaattgatgatgatgaccatatgtaaaataatcacttttctaatttaataaaacctccaaagttttgtccttggaagaaaaacctcccagtgaggaggaatagcaattgaagtaaacctggcccctcttctaagttttgtctgccttttatattttcaatcccattattcattcagcattccatcaagaaatactcactgagccctttccacataccagacacggataacaataacgaactagatagacaaggctccaccttcatacacatttttatctgggtataggaaaaagaaattaagcaattacaatatagtggtaatcattagggaagaaaagtagagggtgcagtggaagtacctagcaggatacctaccctagtacattggtgggaagagatataggggtgtggagtgggacatgtgagagagtctagaaaaagcttttttgtaactgacatctaagcgtaatgttaagatgtcagaaggtatttcaggcaaaaagaactccccgtacaaaggcctgaaggtaagtgagttacatttagaaacttagaagttcagcttggctgcagcatagcattggggtagtgtagccccaaaatggatacaattccctctgctgggcttccctgtaacagagttgacatggtggagaaattaaaaaataacaaagctttaggctctgacctcttgcacattatgctgcctgaaaacatttatgttccagatgcagaaggctaatcagtctggcaagaattctgaggttggaaaaacctgctttgaatcccagcttgagaccagtaatacccacaacaggttgtgtagaggttaggtgaaataataaatgtgaagcatcttacacacactaggtgctcaaataattctctcccttcagttaccttgcttctgagcccccagctggactctgagctgaggacaccatgtcaccatccaccacacatgaccccatgacttggcagaggacgatgcttttcttggccatctctatgtccatctcattcagttctagtctctaccctcttctttagaggaactgcagcattcataaaacaagaattatagccacacgcacctgagacttgttccattacactaattgtactttatatttgtatatgtacttgatctcaattattccttttgagaacatcataaggttgagtattgtaatcactatttggcagataaaagccctaggttcagagaggtacgtgatttatcttgactgaagctttgaatgtagctcctcattttctaaacgagttctgtcaaccctacaaaggctgcctcccagcaaatactgcaatgggcatatgttttaaggtatatttgcactttttttaaacttttaagttcaggggtacatgtgcaggtttggtacataggtaaacttgtgttatgggggtttgtacagattatttcatcacccaggtattaagcctagtacccacattagttatttttcctgatcctctccctcctcccaccctccaccctccaataggccccagtgtgtgttgttcccctctatgtgtccatgtgttctcatcatttagctcccacttataagtgagaacatgcaatatttcgttttctgttcctgtgttagtttacttgcagtttcttttaaaagttattaagactcagagaaacataaacttttacaactatatacctattcatcaatatacaactgtataactatatactctttcacacatattttaagttctctgtgtaaaactaaagttggggggtggtagtggtggcaggatgttctcagaatactagggccttcaaaggaccatcctcaatactttgatgataggtatcactttccatttgcatacttgcccagctatgctcataacagtaaaaataaagcttcctaccttcttaagaataaaaaactgtctcccctgtgaaaataacacaagtgaaagacttaattattcaggtggacttcagctgctgatttcaaatggaattattctcttatgatcacaggatgccttgtaagttacctgtttcaagcccagtctctgcctagggaactgtctcctatgaaaaggagtccgggtggaccatggtggctcatgcctgtaataccagcatcttgggaggccaaaaagggaggatcgctggaggccaggagtttgagaccagccttgacaacaggaccagataatagaccccgtctctacaaaaaataaaaaaaaaattagctgggcatgatgactcacacatgtggtcctagctactcgggaggttgaggtgggaagatcacttgagcccaggagttccaggctgcagtgagctatggatgtgccactgcactccagcctgggtgacagagcaagacctcaactcaaaaaaaaaataaataaaaaagaaaaggagtccacctcacttctgaacagttcaagttgagtccataaatgagcctatttctgtcttccaaagatatccatataagacttttcccaaccaccccccgcaaccttgcttcctttcagtgtttctccaaaggtggtgcccagattacctggatcaaaatcaccagggtactgattaacaggagattcctgggtcccaacgctgacctgaatcatcaccaagaaatggtgcattcgcttttcatatcacattacccagcagattcatacttcgtgaattacacactctagatctctgtcacacaaaaaaaatggtcttaggcaaaatctctcatcttctacttaaaacaactggttttaacctaaggggctgatataaatgctaagtcaagcagtgatttgtgtttaacacttgacagtccctcttccaggtactctatatagtggacttttatacaatatgatgtacagtccttcagccaaccaataatacacctaactacaatccattctacatttccggaaccatgctgttcatgaggatatcacttcagatattttgtggaaattttgaaattatggcatctacagaactccctgatatactagctattgtaagccaagccaaaaagcacatgaaggtagtttggtataattctttatctatcttgataattgaaattgtttcactgtaaaactttacataactgagctttgttttaaagcaaaaaacttgcagatgtgagacagtacgagaaaaaagaatcagctgttaccatcttaaaacttaggatagcctaggtgtggtggctcacagctgtaatcctagcactttgggagtacgaggcagattgcctgagctcaggagttcgagaccagcctgggcaacaccgtgaaacctcgtctctactaaaatacaaaaaaaaaaaaaattagctgggcgtggcggtgtgcacttgtagtcccagctacgggggaggctgaggcaggagaattgcttgaacccgagaggtggaggttgaggtgagccaagatcgcaccactgcactctactccagcctgggtgacagagtgagagactccgtctcaaaaaaaaaaaaaaaaaaaaaaaaaaaaaaaaaaaaaaaagaaaagaaaaaaaaccccaaaaaacttaggataaaatcttaaaacgttttgttcgacttaaatttaaattagcagtttaggatatagtacactgataatgtaattacatacattctgctataaaggcatagacatctttattgggagatatgggcagaaaaattatttcctcagggtggggcatttggctaaacacttgccaatatcctttactgtgtaatttaggtaacacaggcagaaaaggcgtttgaaaagcagaaatcaagtggcaaatatcagatctgagggacgcaatgagggtggagttgaaatccgtggtccttggatttgaaacttaccagcccgtgaacaaggttggtattgcttttggcataagacgacagcctttcttttcattagctcaggaggaatactggctttccaagtgagctcctccaatccagtgatatttgcacatctcacctgggcctttcggttacaaattcaccaccttaaggagccgtgtgaaaaagcaagaacaatcaataagaaggaaaaaaaaaaacccttcagctataaatcagccacgtggagctgctgcagcagcagcggtagtcccacttcctggttggcttcctgaaagcctctcgacaaggggctcagggaagtgggtctaagggagaggtgcagacgagagcgactccaggtccaacggagggggcggcgggccacgggatcccggagggcacaggcgttaaggacggagttattgtccataattacaataaaagtttggggatctgaaagctttaaggagctgagctgcagggcaaaggctaagaaccggactcgggaaaagtgcaagttagttacaaggtagcagggactgtgaagggggctcgcgtggagagcaggggactgcggatctggaagggggcaggtagagaggaaggcagcctggcagagcgaggcacacgggtcagtcggagctctgcggtggccgccagaggggagggggccacggggaggagcggagggaagagcccggggaaaggtgtagccgaggggagttccggatctggagctggaaagggcaggcagcggagagggcggcagccgtagcggtaggggtgggggaaagagggggaggagagccggaggagggggaaggagggaggggagagcggtggcggcggctgcgccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggtgagtgacccgcccggccccctccggcggcagcgaccggcaacttgttttgtttgcccgcgtgtggagggagcaggggcggcggggtcgcggcacggcgtgggcaccgcagctccgcaggtggtgctggcgcagcgcgggccgagggggtgccgagccccgcgcactccgacctccctggccgccgccggcccgccccctcgccgccccttcctccgctcttccccgccccgggctccgtcgccgacacccgcgctgccgcggcagcggctcgggcggccgctctccgcgccgggactgcgggcggagcgggcggagagccgggtccggggggctgcggccgcccggcgtcccgctctggggggccgggaccgcagcgctcacggcccggggacgcggggttggtccaggctgcggcctgtggcgcgtgcaggcctgaaggaggcgagatgccgatgccgccaccgctggtccggtggaccaggccccttggtccagcctcccctcccgcagccgcccgtctgggggtgttcgcagccccgggctcccccggcccgcccgccggggagtgggagggcgatggcgccccgcctccggctcttacggagagcgcgcctccccctcaactccggcggcggggagccggggtgcgatgcgcggccgaggcctcgcccggaccgccggtccccctcgcgtccctgggcgagggaggggcggttggccggagatggcggaggggcgtccccgccccgcctgcccgccgcccccagccctcagcgcctggggaagcccctgctgtggcagtgctcgggcgctatccgggggaagaggagcagttcctcttccttggctgcggcagggctgcttgggccggaaaactaacttgtgtcggcgcccggccgccccgcgccggctgccggctagctcaggccgacgccgaggggagcggcggcgcggagctcgcggcggctccgctgggacgcatttgtctgccgcccagggcgcgagtgttagcgctgacattccttggatttggagggtttagtcaggcgcctcggaacattagttacccggagccgcgccgcgcggggaagggaccgcgggcactgcggcttccctgacccggcagcgggcggcgcgcaccggcctcgcccccgaccctgacctgcttccccccggatgaaccgttgcaccacctgcttcctcctccccgctgggacagccaactgggccggctgccagtgggggtaggagagggtatgaggggctcacgaccgccgaggcggcggggctgcaggaggagtcgagtcgctctctctgttgtaaagtgctttttgcaagtgtgatgagcatcgcttctatgtcatgtttatttaactttccttctggaaagttagcatcaagaagttgggcaaaaaggcttgtggcgtcctttcaagagtaagaatcctaggaggagatcccattatcagctcttcgcctatatcatgagattagatgtaatctggaagttttagtatttgaagtctctacagcagtggaatccctttgtaatatctgggatagattcccatctaagtcatctaaattgatggtaataaaaagtatcagttttccttttcagtacatttgcggttttaagcttctcagctcatggagtgatggtgatctttttataattttgctctcaatatgacttattgacaaaggataactgaatattgcaattgaggatatttgttttaagtcatcaaatggctttttacatgtagctagaaatgtttaaccccctattttctggtagagaaactgacgaaaaactgacaaaactagctaggttcagaatgtcccgcccttctgatgatcttttaaagaggtggcggaacatcagcatcacttgccaactcgtggaatattttattagtgcaaacaaaggatgggccataatgcccatttcagtactatatggtgatgataaagaaggtgatgatatcttgattttttgtttgtttcagtgtacttgataaagtttctcagtggatccagtgtaatttctgtcatttgtcaaaaacaaaaggtagattttaaagacttaacataattaacattaagaggaatgcttaggtatcagaagagcaagaaagacccttttattggcttcccaggtaaatagtaatacaagcaatttaaagtgtagcttataaataataagagcataaataagggattattgccttcctttaataaagactaacctaggagcttttaaggtacagtgctagaaggacaaatcctgtagggaggattctgactcctgagtttctcctcccccttgtggttcttttacttcgatgactattgcatatattccacccatggtgagatctctgcttctctttaatgctgatctacacatggacttttttggatccctttaaatagcctgaacgatccagtttaccaggtatgggttctgcctctactccagcaagcttgtacctgtggctccattcaccctgtgccactttttgtcttgaactatgaatatgtcatacactaaattctgttacagccttgacaacttgggatggtcctttctcatctgcactatttccttgttttaggtctgtccacctgtggagtcaagacaaaagaaacatgtttcttatttccttcccatctctgggcctcttgccctttctctgaagtgaatgatgtgaaaaatgaccttacatttccgatcatattctgttgtgtgattttaaatattgatttatttgaacatttttgagtgccaattatataccaggcatggtactagttgttaaggaaatactccttgtccttaatctcatggatcttgtaaaaaccacacagcaatcaaacctcgataaatatataaataaaaattgtgctactgctttcatagtgaaaaccatagggggcaagaaaatggaggaatttggtcataaaagccttacttgaagaaatgactattagcagtagcaaatccacacaggtctgaagcaactcgattcttacctcctgtgggaaagaatttattggaggggcataaggcagagtgagagaccgaggcaaatttttgagcaggagtgagagtattaaaaagctttagagcaggaacggaaggaagtacactttgaagaaggccatgtgggctacttgagaaatccaagtacctcgtctgaccctggacttggggttttatacattggcatgattccagggtttgcgtttcttctcccgtgattcttcccttggggtgggctgtctgcatgcgcagtggcctgccagcagcggggaggggctgcctgcagtgtgtttactgaagttttactcatgctcacttgaggcatttttcccttacaatttgagccttcctagaggaagggcatatactagttaaaagctgccattttgcctattagtgcacatgctggagcccacttgcccaactcctgagatcttagtgggaacctgctgataaccagctttaggtgttttctatctaatgggagactgcctttccatggtgttggcgcgaccaattattatttcagagagacagtttaacaacggcctgaccatcacctgatggccgcctgacattcctggtggtggggggcctttcctgccctgctcatgtctgcctagctgcctactctgacttttgaggcgaaatctgaacatttcaagaaaagtagttaatctggaagtgggtggcagcattcttgagaaggagcatttgggcaaaggtcctgaggcaggaggtagcatgagtgaaatagtgagaaactaggagataaatattgttggaacgtggagaatgacaagtagaatgatgccacacaggaaagcatgggtctcgtagtccatgctaaggaggagatcttaagtgcggtgagaagccgttgaaagattttaagtagggaagagtggatttgtgttttgaaaagatcactctggctgcctacagaaagtatgtatttgtctatagaacaggtagcaggagtcctggtgggggtcatcattattcaggtgggacataatccttgcttagattggcagggcggtggtagagatagaaaaaaataaattgattcaagagctcctaaagatgcaaaggcatcaggatttggctattggatatggtagtgaaggtgtcaggaggcctaggatgatagattatttgtttcattatggaaagttctcaaagcaaaatgtataccttcttgtattgtattttatgattatgggaagcttttttttttttagtctttgccctctggatattttaaggtcagcatttattaagattatctgcttggacttgcaaagcacagaaagttcctttaattaaataaattatgtcccagactaacaccatttatcccaggttttagccctgagtgactgtctacagttgacccataagcctctgaaaataaaggtttttaaaggaaatgttgacagatccattaaaacagcagtcccccacctttttagcaccagggactggttttgtcaaagacaattattccacagactgggggagttgggttgggtgggggatggtttggggatgaaactgttccgcctcagatcattaggtattagattctcataaggagtgtgcaacccggatcccttgcatgcagttcacaatagggtttatgctccatgacccagggttggggacccctgcattaaaacattcagtactggtgagaagctgtgtgtaaactaatgactctctggatatgcaaatgcaactttagtcaagtcattaatgccacttaggttcagggtgtatataataggactaattcaggaactagtaggccaagaggttttatgtgataggcaagctaacaggtttgaaaggaatatagcttaaatgaggattagtggctgaactgattaccctggcagtcaagttccaccttaccaaagccattttatctcagtgatgatcagttgtaacctgaaaaattctgcccttgaacatgagattgtacttcaaatggaagctctgtttatactattagggatggagctatcacttagtgaaagtgtagtgtcttaagtggtcactgttctctcagtttcccaggctatacaccttaggattggtttttgtttcctttgctgttttcagtgtcccatcccccttctccccccacacataataatgattaaaaatatcacatcaccaagtctgagaagtctggggtttatagacttcctgaaattaatgcagaacttttgcatacatctacatttttttctaggttgataatcagaagctttcatgtttcctaaagtgtcctctaaaccaaacaaggcttccagccactgaccatgtgccctttgaaggcagggttcatgtttcctgtttgttgagtatttcctccatctttcctggtgctaattttatggaaggcacatattaaatatttttcaaagaaactaaggtacatccatttatgtctcccacataggtctgaacatttcggaaatgtttggcgaattcctaagaattgttgtatttatcacttctgtggaaaagttttccatccagtggtctatgtgaggtcaggcatcagccctgttaccacctgcttgcccctcccccatccccatcctcccctccctaagacctcatgaagaatactgataacacctgaagtgggagttcctgctctcacaatctagttgggggtggggagagctattgcttaatccagtagcaatgtaaagaaataatacaagaactgtcacaaggatatgtttcatcagtagtcaaaccagtaggtggagaaggcttaaaatggcctttggggaatgcacagttactagtaaagagagaatgaaaacttttgaacagcagtctattttgtgacttaggctggttgcatgggatgggagataacgtgtgagatacgatttgggttcctgtataaactgttagacaatagtaaattggagaaagaggaagagagaaaataattcacgaatgaaaagcaaaattctgagcttgagccatctgtaaacagaatatgtggaaattctaacttgagttattaaaaaagttggtcagcaagatttgagtagctattgaatgaaggaaaatgactgtgattattcagctcctaactagataattgtctttgttcatattttgaatttcgattctcattcctgaagaatgaatgtacaatctgaaaagtaactaaattaaagatttcagtaataacagcaacaataatagtttacatatattgaatccttactttgggcctaatacatattctacatgtatttggttgtttatttgtaacaaccaccctctattgcaagtccgatggaatcccaactttatagatgagactgttgtggtatagagaggtgaactctttgtccaagtttattcacttaattaattgtagagccaggattcaatctcaggtgttctaacttcagagctgtgctctctgatcttgcactacagtttttaacaacacagacaagtacacatgggctacattaaaaggtggatatgtagacgctagctgggtaatttcagataaacactgaagacaatatagatggtccctgacttaccatgattcagcttacgatttttgacttttcaatgggtttatcggtgtgtaaccctgtcataagtctgagcacatctggacttaagatgtcttatgattcttcaagtttacagtgggtttgttgcagggtgtaaccccttgtaagtcgaggaacatctgtacatggtaatatgaaagagaatgggaggctggtgcggtggttcatgcttgtaatcccagcgctttgggaggcctaggcaggcgaatcacttgaggtccggagtttgagaccagcctggccaacatggtgaaaccctgtctctactaaaaatacaaaaattagccaggcatggtagcacacccctgtaatcccagctactcaggaggctgaggcaggataattgcttgaagccaggaggcggaggttgcagtaagtggagctcgcgccactacactcaagcctgggcaacaaaacgagactccatctcaaaaaaaaaaaattaaaaacaaaaagaaagagaatgggttggaagggaccactcagggaatgtcagggaaggtgatggccagagcagagtcttcaggagtaagtgtaagactatcatgcaaatctggcggaaaagcattccaggcagagggaacagaagtgcaaaattcctgaggttggaatgaggctggagtatttgaagccagtatggccggagtttgttgagtttggaggtagtacagtacgggatgagcttgaagatgtagtcaggactcagatgatgggggtgtgtggctcttgtggtctgttattagggtgattatttgttttagtttacatttgctgcccattagccattattatcctttcactctcagaagtgtcctgggttggatggtaaattatatggatgtcttgcttaaagtgtattttcctagataaataaaatgagtaataaccctttttggccacagtttgtgggccagatgcacaagtaaacaattgtgctgggtaagacaaaaactgtattagttaagtccactgagtcctgtgggagcacagagaaaggagcatctagtgtatgggactggatgctgtcagagagcttgtcttataaaaagagatgctggagagatgaggacagaggagactgtgcaacagcataaataactgtgaccaatcctggggactacatggctgaaaattgggttggagaggggtggaatggaagagaggactctagaaagataaatagaatctgagccatgaaagactttgaatggtcagagctgggctataaggaataatctggaaacagtgcaagctagattttagtgaggagagaattatgtccgaaggatataatgaagcttaaactaaggagaaggacctagaaactgaatacagaggaagagattatggaagtataatagaattgcccagtgggaggaggaatcattcttgatggtaaaggaaaggatgttgatgcctttagaaggaatacagctgtccaaagcactggctctcaaacttctttaggcttcggagtcacctagagggtgtgagaaaacggattacttggccccatcccccgaatttctgattgagtagatttagggtagagcagataatttgcatttctaactagttccccggggatgctgatgctgctggtccagggatcatgctttgaggagtgccagtctagaggttatatagatttgggggctgcaaaatgaaaatgaaaaatttggtttggtttggcatatagtattttatagaacacaggtcagtcaagtgaaggtgtcttaaccaggtcgatggagctcagaatggaatcagaagtggatgcatttcattggccagagggtggtgtctgaagcacagggagtgggttggtaagttaaaggagcctgtgtggatggaggagaaaaatgtgtgtattaagaagaaacatggaaaatgccttcttttaggctctaggaggttggtggggagagatgaaagaaggcatagacagaagtaaaatgacttagacgatattgcctaaccgtgagcaaaaataatttctttaaggacagggccatcaacaaattcagatgttaaaatgtttgagaactgattagaatgaaagctgaaacgagtggctgtggaagcattacctgcctgctaacctaaccagtagtactttggtctagagagggactacagcagcatcatcattagcatctcagtaaatattgtggcccagaaaaactggttcagatgataaagaagttcaggtcgtgaagagtcatcttcactatgggaaaaatacaaatagagaaaaagttttattagagaactgtaactatcaaagaggaacttaacccatttttggttatatctgggctaccataactttatgtgcctttccacctctccctatccgcaagtctgtgtgtgtgtgtgtgtgtgtgtgtgtgtgtgtgtgtgtgtgtgtgcgcgcacgcgcgtgcgcacagacacctatgtatatatattttagttgtgatcatatataatactatataagatagatattgcaacacatattagtctttttttactcatgtctgaaatctggtgatttgaaaagctgtgactagaaaaccaatttaatatttaaagttggaaaataaattttattctgagaacatgaggcaatttttagtttttagtacattaatttgactgaaggatattaaaaaaacaatagcaaaactatgctattctcagcgtagagaaaatgtatgctcagcatttcaatactcttagtttttaaaaatgaggtttatcattaaattatagttcagccctgtgatcctgaaagcaacactgagacaacatgaactgcagtcacctagggcctatgtctttttggaaagggaagagctaactttcagttgcttaatttgctaagaatcctgaatatttccaaatgagaaatgttctcatttctgcaccattataaattcccttctgggcttcccagccttggaagcattttcaggcatcactcccaagaagcatttaaacatgccgacagggagacctgattcacttcactgaatacaagaactggtacactgaaacttgaggaaaaatttaactttacattatctaattaggtttatagaattggtgcagagcagcctggtttcccaaatctagaaggtacgattaactatagtattatatcaataccaactagtctgcgaataggcttctaagcaataggaatctgttattacaaagaatattttaaactggatgagttaaaattaagtcacatactatcggaaaccattttgtatgagaatagagtagatgacctagtcattttttaattttaatttttaccaattccctgggtttaggaatacatctgagcctcaagaggtatgctactgtcttcagtagtaaacttaacatgctcagtgattatctggcttaagtgtaattttggcatttgtagttacctttatgaaattattttttatgcatagctgtttactatgaaaactatgtattcactggtaaagctatgcttcctatgaaaactgtgtattcgctggtatcttataaaaagaaatggtattatttattatgtaagtatatcttaaataggcagtaactgagaaattgccaaaacttttttggagcgagttcactcttatcagaagttgggtatgtcagcatttttatttattaaactgtttgtattaataattctcctttaacttttagttttccttttaatagaaacatcagccaggtgtggtggctcatgcttataattctagcattttgggagcctgagcctggaggattgcttgaggctagaagcctgggcaatatagcaagaccttgtcgcttataaaacaaacaaaccaaacctgataagatattctttaatgtgagcaaggtttgcaagtagctttttcaactgtgcaaatgcccaactccttctacaagtggaacccttgatttaaaaccaacccattgattctagttattaaagtaaaacaatagtttcaattcctaatgtagtatgaagagacccctttgaaccatttcacagaattttaagaattaatacttgtagagaagtgatatcatgacaacatcaatgtagtatctttatgcatctgtgagaatttggtttttaaaaaatatattccttagaaagcctaaatagaaaacaaaacaaaacaaaagaacagtaaggtacagttgtacattgcaaaaaagaagtccttaagtcatgatgcgtgaagttctctagaagttcttgtcagtacttactgctgtacttcaaattttttattctgtagatatgaagtaaatattttatatactttttattaacatttattatcgcaaaaatagttcccttacaaccctagcataaattaaaactatcagtatacttaagtgagtcatgcaagtgtcattttgccaggatatataaaagatatctgagtaatgatatttagaaatggaaaatgtgaaaatagcatcattataggaagattccaaatctgtttagatttataggttatggtcatttatataaacattttaaaaatgacaggaacagtctaattacgttaagtcaattaagttttttttttgcttgattgtttaatgctcttatgaaaaacacatatttgtaaaagaaattatttgcctagaaaaatttaccatgcaatatatttcatcatattggagttccttttttttttttttttttgagatggagttacactgttgtcatgcaggccggagtgcaatggcacaatctcgactcactgcaacctctgcttcccaggttcaagcaattctcctgcctcagcctcctgagtagctgggattacaggcgcccacaaccatgcccagctaatttttgtatttttagtagagatggggtttcaccatgttggccagactggtctcgaacttctgacctcaggtgatccgcctgccttggtttcccaaagtgctgggattacaggcgtgagccactgcacctgcccagttctttgttaatgaaagcctgtgtacctggaagtcaaaggtatactttgcatagccatttcaaaacttgtcttaggtattttctaaaatgtttgtctcattggatataggttttgattgtgcttacttgagaagacttaaatctttacccttctcctggtagttttcttctggcagttcagtattttgccatgcaatttttattagacaatttgatcattgtgtttcttattgcctaatccaacagatttaatcttttaatctcaaatacagcaaggtgtgctgtgcctttacagtctgtttgcagagttttacatcttcgtttgaaaggaagtgtttaaacacccctgttcaaaaatctgctagttcttgccaggatgatttaaaatgaattttaaaaatccattagatttttggcaaataagctctcaattatggtacagaataaatgactacaaagtgctttttagagtaatggaatagaaatgactgaaattttattactttacacatgcagatttttctactgtggtagatgttcttaaactaaaagattactgtcaagattggaaatttttatcacttaaaatatataattatatttgaacatttaagcagaagattgctggaatggggatatacaggcctgcagtttcgttaactgttgctccctgtgtgatggcctcagaggaaattctaagtccagtgttcgtcaaagaggctggagaatgtttcccttttagtgatcagtgaaaataaatttgcttacagtccagggagatcatggtagtagagaaaaaaatactttagtaaataattttctaaaattctctattctaaaaatatactaagaaaggatgatttttaaataccttggtattttaaagaaatacattttctgtatgaaattaagataactctattcctcttcttatagctaacatttagactctaaatcatggcacatgtaacacttctattttaaaataaatgtagggtacgtgaaagcacagttgttaactttgaaaattttgaagagtggaatcacctacagacataataaagctgaaaataccatggcttttcccaggtcctgctgtttgcttagcctgagaaaggaactgccggtatcatccaagtattggtcaaaatacatatatactgtatggtcattctcatattatttttcccagtgtcctatttgaaaatctgaggaaggttttaatgaatgcggcttcgtcttactttccattaattatgactgcaagaagagtacagccactcttgtttgatcagcctatacactatgactaaatggaaagtgaatcacagccagagagtctaatagtttcacagtggtaaaatcatgttttgtaagaagcagttatcatccttgaccaccgctctgttaactggtaacagtaagataaaagtaaatgttaaaatctttcttatatgttggcaaaaatcacttcctaaagataaatgaatggcttgaaacatttattcttatttgcaactacttctttagcttaagtgacaggtacttatgtttaaaaataacatgtcttgtgtaatgatttatgattctgcatttataaatgcagaaagaataactaaaaggaagttgtaagtgtcagttaaggaatagatgcttttttaaatatagaaaattagaaaacttaaggtaagagcaaaagtaatatacatttgttcagtatttttgttttctggtgaattgagatacttttcctactattcctttaattctttttaaaaataactacaatctatttttttctcccttggaacagtggattcctttctctgattatgaggcctggaatttgagtgattcattggtcagtttcttttgggttccagtgggtgctaaaagtaagaatgattattttaaggataaaaaatgtcagttgtatattttattgactgcaggtagctagaaaaagtaaacttgccatgtgggcacacagcgtgttgcctctgaatgatgaggcaagcaggttactcataatacacacacacacacacacacacacacacacacacagcgtgttgccccgaatgatgaggctagcaggttactcttaatacacacacacacacacacacacacacagacacaacagcgtgttgcctctgaatgatgaggctagtaggttactcataatacacacacacacacacacacacacacagctttttctctatgtacctgattcttttaaattaaagataaccaaacctttgaatgatgaggctagcaggttactcataatacacacacacacacacacacactctgctttttctctatgtacctgatacttttaaattaaagataaccaaacctttgaatggtgaggctagcaggttactcataatccacacacataaacacacacacacacacacacacacacacacacacacacacacacacactgctttttctctgtgtacctgatactttttaattaaaggtaaaaggtaaccgaacctttaactcttgagccagtgataatgagaaaataaaatttcatttctaaaattagagataatggaacttaaaaaaaatgtgttctctgtgtcatctctgtgcaccccctcccactattcctctcacacgctgcactttttttttttttttaaagctgcattaataggctgttatatcctttgaaataccacaggtcttgagagggatgaatgatgaaatgtaaagatcagtgattgagcaggaatgggagaaagattagggattgggttttctggcacaaggctcctttctgtcaaaggactgcaaattttcctgggttgacgtgggcttaattttttttttttccccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagacggggcggccgggcagaagcgcccccccacctcccagacggggcggcggccgggcggggtctgccccccacctcccggacggggcggctggcctggcagggactgccccccacctccctgacggcgcggctggccgggcggggactgtcccccacctcccagacggggcggctgccgggcggagacgctcatcacttcccagacggggcggctgccgggtggaggggctcctcacttctcagacggggcggccaggcagagacgctcctcacctcccagacggggtcgcggccgggcagaggcgctcttcacatctcagacgggtcggtggggcagaggcgctccccacattccagacgatgggcggccgggcagagacgctcctcacttcctagacaggatgagggtcgggaagaggctctcctcacttcccagactgggcggcggggcagaggggctcctcacatcccagacgatgggcggccaggcagagacgctcctcacttcctagacggggtggcggccgggcagaggctgcaatctcggcactttgggaggccaaggcaggcggctgggaggtggaggttgtagcgagccgagatcacgccactgcactccagcctgggcaacattgagcactgagtgagcgagactccgtctgcaatccctgcacctagggaggctgaggctggcagatcactcgcggtcaggagctggagaccagcccgaccaacacggcgaaaccccgtctccaccaagaaatatgaaaaccagtcaggcatggtggcgcccgcctgcaatcccaggcactcggcaggctgaggcaggagaatcaggcagggagattgcagtgggtcgagatggcggcagtacagtccagcctcggctcggcatcagagggagaccagggagagggagctcggcatcagagggagaccagggagagggagagggagggggagggggagggggagaagtgggcttaatttaaaattgccttatatatgcagtgatgaaaatcaaatcaaatttaaattactatatggaacaacttcctgataatgtaaaaaaaaaactgatttaggagagggttttcggtactttgaaatattaatattatgaaagttgaacactgatgtttcaatctgcttcactccatccccattacttcttgtcagctgtctatgagcattgggccacttgccacagttttacatgataaccatatttaagtggtaaaaaagatcagaacatatacagtgccttcttaagtcaggttcctgatttatttctggtactatccatttagatacatattaatttacctaatttcttaaatccatggaccagtactgatattcctgtttgtctttatttaggattttacatgtgtacgttaaaaaatacattggtaacagctgactgacaaccaaaaaagtaaaaaagcaaaacaaaaatcaccgtgctttgacaggtttgtcatgaagcaaaatgcatgagaaatttgatctgtttcagtttgcttgttatcagtcagaaatcacctttgctttgcccagagaagactcaggttcactgaattctcttcaccactccgtgaaagtgtgtagcagcatggacagcccatgttatgtacagagtaaatggtgcactgggtggcatgtggaatcttgaaaggacagtgtctcttagatgcttaacttactactgggagtgaagaagatcaatgaatctcaaaaaaaaaaaaaagtggaaaaattccttttggggaaaagaagctagtataatttagggttttaattactatcatacttgattgagagaaatcccttactcttaaaataatacaggtactgcatttcttattttataatactgcttaaatgcttcctgtcctaggcagtataatgaattaaaatgtagtagatatttagcacaagcaaaaaggacttacagtttaggaatactaaattcagaactctgtattgtaacaagttaccaggaagtagtgggggttaaatctgtgctgctgggaaagtgtgttttgttttgtttttttaatttccttgtatacatcttagagtctgcagtttgtatgaaccgtgtgctagtcaagaaagagataaataagcattatttaggttcaagagatttagcaatcttatggttttgggataagctgctatcctagtgatgttttcttgtcactgtctcactgagattttgaaaaactcaaacacatccttaatcaatttgaaagattcctagggaaattacattcaacttgattatggtattccttatgagagcttgggcatagggcaaggagagtgaactttaaggtgtaggaagaagataagtatgtgccacataaaaggaggaggggcctgctatatagtacaaggtcatggcttaagccaatcatttgtcatggggttggggagtctgaaggatgagtgggtctattttaaaaaaaaattgcgttgataaccatgaacattaatccttatgaatactaaatgttctagagaaattatattgatgtgtaattttccttattgtgaaacatatagctccccaaggacaaggtggcagctggcggattaaaaataaaagctgacatcattatatagtaaaagtacacatggactctgacatgggttaaaatgctggtgcaatcactgttaatagcgttagtgagtttcgctgagtgatttactttctgagagcttccttttcctcatctgtaaagtagacataaaatcaacttcatagcaatgttcttgtgcttcctttagatacgtttatcagagcttctatggctgggtttaacttgcacttttatacatactgtttttccttccttctgttccttcttcttggatgagcaccataatttgtacatagtttcaagagtgctttaaaaatgaaaatacttaagttctgcaaacttattatgaattcattattttgaattgtaagtgaaggagggctgaatattgtcttttctcctggacttttagacttttgccttaaaagttatatccttaaatgaacagtgttctcaaatggggaaagaggaaaatattattgtttacttacttttttttttttgagatggagtcttgctctgtcaccaggctggagtgctgtggtgcaatcttggctcactgcaacctccaactccctgggtctcctgccttactctcacgagtagctggcattacaggtgcataccaccatgcccagctaattttttaatatttttagtagagacggatgttggccaggatggtctcgatctcctgacctcgtgatccacccgcctcggccgcccaaagtgctggaattacaggtgtgagccaccgcacccggcctacttacttttaaaatacatttacattaagaaaaaaagaatgtatgttcattgtagaaaatattacaaagttaaagcaagtaagaaacaaaattatctacaacccatcctatccaaagataattatcattagctattggtgtatttcttgcctaaatatatgtactatacatagacatagtccacagtataaataaactctgtggattgcttttttaatttcactgtagaaatattttaattgttgttaggatatgtatagatttgtaattttttttaaccatctggtcattttagtattgagatggtttgaggaaagaggacattagaaaaaaaaaaaaaacctgtgtactgggaattacagatctgaaattgtcatatacaccacatttgcaaaattttttcacctgcccttgaaaaaaaccaaggcatgattttgaattttataagatggtctattaagattgctgaaacttggagtgctttctggcaaaaccagcaattaaatgaagagaaacagaagccatcactagaagagcaactattttgtggcagttacttgtttcactatctcttccctgttctttaccccaacatagttcataacttaaagttgtggactttaaagcactctaaggcttttaaacttctgcctagtgagttagtattaagaaatttaagtcagtgccatggggttaaatatgaggtttaataaaaatattggtttcttaattttgtttattagtcttactcctatagtctgtgtgtcgtgaagcataatttctcttttctttctcctgatgcaactcagccactccaggattttctcattttccttcatattatgaatatgtaaaaattaaaacaaataccttttcttttagtcattgcatagttggactacacttatttcactctgaggtgatagggctcttcttttctatgtctttgcatcttaaatacatacagacattatgcatttatttatacttatatactaatacaacaggtcagcacagtcactcctcacccatgtggggagccaaaattctagtctgaaaattgagcatcaaatactaataagtaacttatactgaactcttaggtatgtttacattcttaatttaatcttctgacattttacagttgaggaaatttgtggcttagagaagttaaattaccttgcccaaggtcacttggtcttctaggtaacaactagagttcaaacctaggctgactgcagagcctaccttttcaggtgggattcagtaccaccaagtagcactttctgaactgtgttctatgaaccaaggtgtattatcaggcattactttaaacaggggttttgggccagtaaggttgataagtgttgcatattgtatcaccccctcagagatttcacggcatacattggtacgttaaaagctttgaaaagtactatagaaaagaaacttcagcattttagcatatctttcacaaactgacctggtcactgatccagtttttaaagaacatccagttttctttaaagaactttagtgtcctgagagaagagaaagcgctgtggacagatggacctgtcttcaggggaggaatctggctgcctctgctcgctgaattctgccttgaggccttcctttcatgttcatgtgcagcatggtatcatccagctgtgtaaatcttaccatccttcaagatcagttcaggatctacctgttctctgaagattttcctgaccacttgagtccataccgatatatctgacctcagcaaagttcctgattatgattgatggtaatgctctttagcacgtggctgtttccccagttggttcctaaactcctcaaaagcagacacaccctactttatattattcccctgtccgctgctgagtagcccctggccttactgccctcgagggagaggttaaagtgttccagtggtttttgtttggtttacaaatactcttcgtctccctggtcttgaaccccggttgagacctgcagttcattctcaatcctcaaacttgaggtgctcatgtgatcatcttacactcatatcagcacttatgctccccatattgttttccatctgaacacctctcactgatcttgcggttatttatcaaaaaagatttctgtttacagtgtatttcacaattaaaaattctactgatagttaaaataggtttcctagaacaacccctgcttggcagtcacctccatcttgctacattgccacagagcctgatgaatctgctaagtatttatgtttaggaatttcttttatgcaggaaaccccaacgttaagtggttccttgactccagttatgagtcaaatggttttaagtataacccatattagatttctattcatacagaaatagatgtccagtgtatgaattatgtttcagttatcggaaactcatttcatatcatggaaatatcaaaatagttcctccaaatcaaatatacttccaagaacattttgcaagcactagagccatattgtgtctattagttggataaatttttctgcataggcaagattgaatgaagtgctttaaaattaaattagtctaataaaagtatgcaccgaaaacaccaccttttcttttggcaactccctgcagtagtcatggatattcttcccttgctccgagggaattctgtgtacaaaattaacattatctatcttcaacatttttactccatattcagtgttcatgaatggctctggaagtctttgaatggtacctgctgggaaacattatttctaccactatcccaatcttatggaaatacatgaaggctgaacaatagattcaactctcagttgattctgttgactctgtgtgaactttaagggatagtaaatatttgaagtttatgttaattaaaatatagatttggctactataacagcaatccaaaatgttagtttttttttttttctcttacataaatacccaaactgataatggcaaaatagacttcatagtcttttatggtactgttagggatccatgccccttctctcttgttactctgtcattcctggagagttgctttagacttcatagtcttttatggtactgttagggatccatgcccttctctcttgttactctgtcattcctggagagttgctttcatctacgtggtctgagattttactaccatgtccacattgcagcagtaggaaggaaggaaacagaagggatttgcttcttcacctgtacgtgtcactttcagtatctttattctaggtagccatgtgcatagctaaaaatggttttagtgagtgggtaactaatgagatagaaagggagaaaggatattgggaggaatcgtagtctttgctacaaggtaataccgtataattttttaaatgataaagttgtataagtaagggtcaaaagtcacttgtagctaactttcattagttccaccttttccttgcctagcacagttagcatggtcttggtatctagtgtaaatctgatcttatccaaacatgaatttgttactttttatattacttggttaactgttgatttcaagtctcttttcagacttgtctcccaagttcacatgaatagggccaggctttaagttttttttaatgcgttcattattaccaagcagtgctttttaacactagtgttcagtaagtttattgaacattgggttatgatgatttattgaaattctacatttattgctttgcttggttgttaatagagtcaatgtctcttgtcttttttctgccaactggaataatccctactccacgtatgtgagctatatcctgtatcagaaatgtagaggaggcgtggaattggcaaagatttgttaccaaaaatcactatcagaccccattgctgttggcagtcagggaaccatggaaaagattatgggtcatggaaggttataagcaaaagtctgtggatttgcatagcagcattgagaggtaggtcttacaatgggcaggttgtattggaggactgaaaaaaaaaaaatggaaatattaaggaaacacacagatagtgattccaagaagaactagcaccaatagggctaaggcaataaaaggaagaggttgggattatcaaaatttggaagctcacaaaagcgcctggcaagttggggttcagatctctggggatgggatggggggggtacttggctggctggctgcctgttgtgtctctagaaaataatggggctggtttggggagtaggagtaggcttgaataaatgctgagaccactccaattactatggtgagttgcctttaagcagcgagcaaaaggatgtaagtctcttccgccagcccttctgcttctgtctagtgtcccctgtttggtaaatcctaatgggaaggctgttggcaagaaatttttgctaagttctagagccagattcacaaagcaaaatatagaaaggtgggtttggaactgaaagataataatcactggcacagtagtggatataaagtcttcctttggcaagttcagctggaagatattgtgccaaacagtactgtgacagaaattagagatggatctgggccagatggtatgtacaagattgagtagaagagtggtctgctcagtcttgaggagtgtcttgcacatataccaaagtcacttttacgtgagaaagcatgctttctattgcagtctagagtttcctttctttccttagaaatccgttgtgaatctattattcatgagtttccatgaccctttgttgaatttgtttgtttttagtttctgtgactcatcgaaaaactacttagtggatttttttaggtgtcttttgttatactggactttgaggagagaaaggtaactaagatataatctctgttctcaggtaagccacaccctggtttgtggtagaaggtgaatgtgaagacactaacattgtatgttaaatattaaaataaaatgaatcatacctgggaagtggaaaagggcaagtctggagaattaacttcgtgcttgtctttcaaagtaggactttgtcaggctgagggagaagtgtgtggagaagtgtgtggtgggtgaggacagcaagtagaaaacacatatttaaagggcatggagaaataattgttaagatgacatgtgctgtatatttaccagttactatataaagaagcgttattcctttgccctgaaatctttctttttttggcttcaaggggtcctccttgtttcagaattttgtatttgatatataccctccccctgtccattatgatttttctgtacttcagccatattgctgagatattcaactttataagcaacaagttcctttaaaaaaaaatacctttgtcttcaaactgaaagccgtctcatccctgtttttatataagttgccctttgcagaacaatttgtagtttctgtatgtggatcctccctacttctgaaaggttgtctggagaggtatcagaatcaccaaacaatgaaagatgcccaagctgccatgccaccagaagggggcatgtctcattcatatgtacactcgagttcttgaattatcatcgttgccttgaaaggctgtagaagtaaattattgggaaaccatcagaatgcacctgcctgagcctttctccctcagtcttcctgtttgtgttcagtggttaatattatcctctccacgtataaaatttgaattcagcaggaccttgtaagacacatgcgtttcattttaagctacatcccattctcagttctctgtccctatccatgggtgggaaggttcaaccctgttccatggacatagctgatgggacaggagtatccaagctaggtcaactgtattctctctcctgggatttttgaatcatgtggtgttgtccactaaagacggcacagagttggttggtaggcatagtaccagggtcagctccttatgcatcagtcacataccaggcaaagttatgggggaggaaaacctaaaaggtttgccaaggaagccagtctatagagaaaggagtgaagtagattttcactttctttccagaaaaagagataaaagaaagatgatatggacagggacaaacagacaaaaaggctcggcctctgcctctgcctaaggaccttctaatattaccatgagacgtgcctgttcttcctgctgattaggttgtgatataggcctgaatccttataacaaacactattttatttaagctagcttaaattggttttggtaacttgtacataaatcattctagagtaacatacactccttacagaaataatctcctgctttaccctaaaggaatttactattatggaaaattcacatggaagccaggaagggagatttttgagcaggaccctcaaatcacatacatgaagtttctgcctagcccttgtgtctcatctgtcttttctctcccctcaccccaactttattttttttaaaggcgttacattcacagaagacaaagcatgtttttgtataaccgtaaaattatttttctataattttttaaagtgatacttagctttttgttgatcttttttgacaataaaataatcatcaactgtgatatatagtatgaaatttgaagaaatttctgtgtaaataagtgataaagcagaaggcagcaaacaagaaaaaggcatttaccaacctcccaaataatgagtagtgtgttagctttgattacaatcccaaaactagtttttttgggtggttaaggttttcatttttaatatcctttctaaagaatatgaaattaatgaatttgaaataaatctgttattagggaggcatccgagtggcttataaaatagatgattttaccaaaaactattgttttttttaaaaggaggctaaatatattcggttgttgacaatactaattattgctttacttatgatgtagttactgtaaattttattcatatgctatgtagttatagtgaaagcaattagactttagttttcaattttcctatttgtaaatggatttaaagtctttttgatagtctaggaaccaattaaatatttctttaatggctcaactaattgctttataactattacttattttaaagtgtttgcttagggtacagagagttaaaagcattaagagataatagtaggcttaggagactaaggatgtaaactaattggggttcttattgtcagatttaatataacatgttaacatacagcatttatacagaggcattctttgtacatgccttaggttgtttaaaagggcaatttaaatttaaagaaggcaatttacttatcatctcggaaattctgtcttgttgccctagggctagtatgcaccatattgcatttaaaaaaatgtttggaaagctgttggaaactttttgtcaacacgtccacatttgcagtaatattctgtggctttgaatgtaaatttaggaatttatcatgttcacaaataaaggagagatgaagtttactaataataaaatgaaactgataatcagttttgaatctaagcagttgtttcagaggcggtttcatgtgagtctttgattaggattttgccttataggagataaatttatttatttattagttttttttatgttatattttgagttctagggtacatgtgcacaacgtgcaggtttgttacatatgtatgcatgtgccatgttggtgtgctgcacccattaactcgtcatttacattaggtatatctcctaatgctttccctccccgcttcccccaccccacaacaggccccggtgtgtgatgttccccttcctaggagataaatttaatctggttttcagccatagtagcattcagactgaatcctgaaaatgtcctctccactttttgctgctgttgaagagatcagtgaagggttttgtaaacctgaaaactctggcttagattttcttagctaaatttctacttagaatcagtgagtaagtgacatatgttaattttcagtgctagtttaataataactttttcataagatttggtttcacacacacataaagtctttataaagccatttgtttcctttaatttcaagacccaaaatattaatttggaattaatattgagtgttttgctcctgatgaagtgtccttaaacaagtctgtcatattgtttgaacttttatttctacttcctcatcttcaagtatttgtgactatttctcatgttgctaaatttagttatttctgaaaaagtaccaaatgacctataaacgcaggaagaacagtcttccaaagcctgaagggggctctgagtgactgactggctctgggcctaggctactttgaagtgcaattcacgtttgaaacagttctcggagtctaatgcccttccattcagaagacctgtaaatgcttgagttgtttctccatcttctctaaagaaaacctgactgtgtaatttctctaggatcttagggtcatgctgcaaaggaacaaaggtgacattaaaaaacactgtacttcctagttgccaataatacctgagtataaccccaaaacatatttcttctctaggaacactagatcctgaaggtaatctctcaaagtaggagcagagttgtccttacctggctaatcttcttggacaatctgtgattactgtcaagaacttctgttccattccatgcttacagtgaaatcagataagatgatgacttccatgagacaggtaaaggaatttacacttggtttactcagatgcatagtctcttagttaagacagtagatctggcatttgggatttaatagtgaggacaaagagagtgcacacacatatcactatgtggtttctattaacaatttaaaacctaaaactaaaacatgcctcttattaatgttgtacagtcaaaagaatagctgccttcaagttaacatggacatgactaataacttcagctgcttactttacttgctttcagatgtggaagagatacttactcgcaaattcctaattaataggggaaaaaaatctaacagttggacaatacaaaattacataacaattttctagttcatattttaatacagaagggagttttaagttggaatttttttttttttttgagacagagtctcgctctgtcgcccaggctggagtgcaatggcacaatcttggctcactgcaacctccacctcctaggttcaagtcattctcttgcctcagcctcccaagtagctgggattacaggcgcctgccaccatgcctggctaatttttgtatttttaatagagacggggtttcgctatgttggccaggctggtctcaaactcctgacctcaggtgatctacccgcctcagcatcccaaagtgctgggattacaggtgtgagccaccaagcccggcccagaatgtattttaagctgtttaaaatggaagcattttatatattctataagaccttctaaaaagaacttggaatttggagcagggataaggcactgttatttggtaacgtgaagttttttttcttcaacttttaagttccgggttgcatgtgcaggatgtacaggtttgttatataggtaaacgtgtgccatggtggtttgctgcacatatcaacccatcacctaggtattaagcccagcattcattagctattcttcctgatgctttccctgtccccacagacaggccccagtgtgcgttgttacccaccatgcgtccatgtgttctcatcattcagctcccacttataaatgacaacatgtgatgtttggttttctgggtaacatgaagatgttgttgtcatgaaaacaggtttgatgactatagtgtaatagtgtaataagggcctaacctcagagacactttcacatttggatttttctttgcttcctagatgttatctttattcctgttgcttaaagaaccagtttaatgcatatagaatttgggttctttgcccagacacccagaggtacatttgataggtacctgattcagagaaggtgaaaattttagattctctatctctctctctcccttttttttttttttttttttgacaggtaaacagaagtaactatcatttggggttgtcaagatatgggtagtagatacctaattccatgaatgccttctctgtgcaagtgctggaaagtaacctcagacttccagactcatcactgagattctttttcttaagcaaaatagtgacgctctgcaggatttctataactgaagttctctaaaagataaatttatattgcattaagagggtagagggtagtatttagagctatgctctcttaaaaagagtaaagaaatttcatgtatatgaaggaacagaaagcatggggataagttttatacaccctagagtggacttttatgataaaaagtaatttacttgttaatcaatttaattcagcaatgggaaaagatctttctcttctttctgaaatcttacacagtgaagggatgaaaatggttatactattggtaatcagagatgttcctattttgttttgatgtgtagattccgtagtacctagtgttgttggatattaagaaaaattctaatccctgttcttgtgggaattgcacaaggagcaatgtaaacacaggtagtggaggtagagatgtgctgtcgtctacttctgctctaacttgagcagccacatctcactcagggtcatcccataggatgtccaggctgtggttggagagaagtggggggatgaagacgtggggtgcaataatgggaggaggatgggctttgggaccagaaggttgtgaatttgagttctggtccatcttcttggcagctgggtcgattagggtggtgaattagctggctgaattacttcacacatcagagcctcactttcctggtttgtaaaatgcagattgtgcccctctcccagggctgccatgagggttagggaggccaggaattaaaacatgtaaaccatgcattacactgcatttcaacccctgcaagggtgatgcagctagctttacctgattttacttggattgtttcttttttttttttgagacggagtctcgctctgtcacccaggctggagtgcagtggtgtgatctcggttcactgcaagctccaccttccgggttcacgccattctcccgcctcagcctcccaagtagctgggactacaggtgcccgccaccatgcctggctaatttttttttttttttgtatttttagtagagacggagtttcaccgtgttagccaggatagtctcgatctcctgacctcatgatccgcctgcctcggtctcccaaggtgctgggattacaggcgtgagccaccgcgcccggcctggattgtttctttagtgaagaaaagactggggagaagggcacttcttaaagcaatgtcaacagcctctcatatagttaatacatctctatgtggcccttcccagagtgtccttctgtgaggagatccattacaaatacaaaaaattcatgtggccagataagttctatgaccagataagtctggcaaaagctgtttattatacctgcctcttaaagattcacaaggctgaaaagtcctgaaggaatgtaactttctctaacccagaatttcacaaacttatatgaaaacaaaatctttatttagtatgataacctattggcatcaattcatatattatttcagtaaatgttggagactttctgtgtgccacagacaccttcacaggctgcttcagcgaggactgggggagggagagagagatgagtaaaaagattgaaatgatgattccagatcatgagggatacgttgaatataataaatcagtgtgggtattctgggtgagaagtgagagctatttcagatcagatggtcataaaaggcctcttgaagaggtgatatttgagctggaatctgaataattcaagttaactggccttgcaaaaatcttggagggtagaaccttctaggcagagataaaagcaaaggaattagtgttcttgagagcacactttgaggaaagctgttgcaataagagcaaagagcatgtataagaagtatttcaatcaaatttttatatacaaaatatgtagtaaatctttttcgagcattatgtgctagatactatgtgccacagacacagagatgacagttacatttaaagagtagagtagttcggagaagaaagactcaacatctaggggattgagtgataagttgcatggtggaggtagcatgttgtagtggctgaggttagagccagactgcccaagttcaggtcctagatccgccacttacttgataaccttgggcaagctactgacatctgcatgcgaacactggggacattcctagtgcctctcagtggattgttagtatatgcaaagttgttaggacagtgcctggaacataaggaccacatgctaaaattgaagatgatgatgttagagatattcccgtcataaccatcatcgttacagttgtcatcactgtaatcttttagtgccatggtccagctcagatgcctgagtcttcatgccctcctaatgggccccaggtttgcccatcagagtcttacacatgatcacccacaccatgtaggcactattcttacccagcaaagagattaaaacttgcttcatctgttttctacccaatttaactttgttaaccaccctcttaaaaagaagtttcttgaggatttatctctggttgtcttccagtttgggcggcgggtggtgggtggtgatagttggtaatagggttgaggtaggatggaataaatcagaatctgcaatgaaccacttgctggataattagggtagatgagaaccacaggactgtaataaaaatggattatcataacgatgaccctacggtgctaaatgatgcaccatgttccttttgaatcaacaaaagttaaagtcttcctggaatagttttagtacattattgatctctaattcttagaaaattggcaatccatgtatagaataagaaagtctctattgctgcaaatattcataacctgaagaacccattccctaaccattttagataaataagatttttataaaattaaagcaattattaaaattctatttgtgcatggaagaagccatttagctaaccaattatatatctaacttctgtaacagcacttcggaattaatctaattgcatcctattgaaagtcagtcaccttttgcaacatgacaattttatgccaagagaatgaaaatgtcaggtatttccattacagagagtcacattttcccttgattgtttcaggcagaaagaaagcgactcagattaatctgtttagaactattttcagttatctgtatatgtcatacatgctgtcatgttctaagaccactttgttcttggatactgctttccaaaatctatgggattctactcttaaaaaaaaaaaagaatatctcgctttacatatcattttattctggggaagcctaattagcacattaatatcagagagctgacaacctcctacatgttattttaggattccatgtgcaagaccatattattctagttatttgaatggcacgtattctccacagcttgctaacagtagttttgtcttttaaaatttatgtgtttccagtgtttagggtctgctaaggagtgggaggtgaatgtgtcatcataaagaatgttgcagcaaatatattttgcaggatacagccatttccattttttgtagtacaaagatcctatcatcctgaaatcttacattgtagattgtgttatgtgctgctttttatttcagtgagatgaaagtaatattctgaatgagaaaagaattagagtagcatttctcaaatgccagttttgaacctaagtttaaaatagagagatttatcactgaaaagattaagagaaaagaaagaacatttatggaatagggattacactaggtattttcatagaggtatttaattcttgcagtcaaccttcaagatctgtgagatttatccatcacaaataaatgtgttcagattaagtatgtggcctagcaattttgtaaattactgttttttactttgcatttaacatttatgtaattccaagccaatattttgaacctacttttaacagttacataagaccttttagaatgaattttgtatttatcttttttctcctgattttctggccttcatttttctgccaaatattttaaaaaatagtgttttactgtatgtttttagataagccacctcatgccattcttgatataagttgtggttattaaattaatttaataaattaactaattataaacttggccaaagtcacacaggtaagaaatggtaggtccaaatatataaacctaaatatgataaatttccaagtacttgctgttctctttgcaccttgctgccttatggaatcaaggtaaaaataaagaaaaaaatgtaagtgctttgaaagggttcacagctatttgtataactagaatataatctattttgagcaaagagaattgggttatatatcttatttctagattgggccaaaccagtaagtcattttcggtttacaggattcaaatcaacattgtattaacattaatgaaaatgccaactcccattcagagcagatgagcaacaggtgatatcagagaggacctcttagaaaaagcaccttttttttctagtaactgctgattgtgtcctacaaccttctgtgttaattagcttgaagtgcctcaataatgcatcggccaggttgcccagaaccctgcaaacatcttttcatcatccctcatgttgtgggctttccttaataggaaggcagataacttcagatctttatgtctcttagattttatagttttgaaaaagtgacaagtctttttgtcaatagatgcctgggtcttcttatacttctgaagagaggaaaatcaatccaaaagaaaacacaatagattctaattttatggactgttcattaggaagtctggttttgcttaagacaactgtgctggtctagaagttcatagtatttattgatttttcttctttctgatgatcattattgctattttgtagcaatattgatattgtataatataaattctttttattttgctaaagggaagtgcttctgtattcttgaaaactgagaatcaaacagtatttaaagtactttttctggtttatccccagtgtctgtcatagggcatagctctaaagaagttcactcagatatcaagggtgaatgaaaattctctgaaagagaagtacaaattattgtgggtccaactctttaccatacattatagaaggcagagaaaccatgaccacctaaacttgtaggacactgtggggagaagagcctatgaagttgattcctaatgtaggtctgcagtggccatggagctgagaaatcaccgaaatggggaggaggaggagggatctgtctgcctaacttcagtaatattattgccttttcttagataaccctcttcactcttttctgtctcctcaatccttatctagctgtcaaagtctcgttcaaatcctgcctcctccaggaaatcttatctgctcactacaactcaaactgatttgttgacctggccatttacagcatttgtttgaccataccacctggcccttaaggctgcctggcgttttctaataaaagctatcatttttctgaatacagactatttgcttgcttttatttcttagcagctccatgagatacatactatcattgtcccaaatttatattgtctgtctctcccttcacatctattaatatttgctttatgtatttaggtgtgctaatgttaagtgcatatatatttataattattctcttgatgaactgtatcctatactactatataatgaccttctttatctcattttacagtacttaaagtatattttatctgatacaaatatagctaccctgaaagtatagctctcttttgatttcaattttcatggatttttttttttttcatttctttactttccgtctatgtgtccttacaggtgaagcgaatctgttatggacagcaatagttaggtcttgttttttttttgagacggagtctcgctctgtcacccaagctggagtgcagtggcgcaatctaggctctgcaagctccgcctcctgggttgacaccattctcccacctcagcctcctaagtagctgggactacaggcgcccgccaccacgcccagctaattttttgtgtttttagtagagacggagtttcaccgttagccagaatggtctcgatctcctgactttgtgatcctcccgcctcggcctcccaaagtgccgggattacaggcgtgagccaccgtgcccagccaggtcttgtttttttatccattcaaccactgtgtattttttgagtggagaatttaatccatttacattcaaagtaattattgacaggtaaggacttattattgccattatgttcactacttcctggttgctttataaatccttcattctgctcttctctcttgctatcttttttatgattaggtgattttctctgctgctatgccttgattccttatgatttaaattttgagtatcctccttaggttttctttgtggttaccgttaggtttatatacaacatcatctagttataacaggctattttaagttgataacaactcagattgcattaaaaaactacacttttgctctacttcctcccacattttacgcttttgatgccacaatttatatttttatattgtgtatcaacaaattacattgtagctattatttaaataatttatattttaaccttcatactaaagtataagtgatgtatacaccactatcacagtattattctgaatttgactgtgtacttttaccagtaagttttatgctttcatatgttttcatattactaattagcatccttttctttcagcttgaagaactccctttactatttcttataagacaagactagtggtgattaactccctcagcttttgtttgtctgggcaagtcttttatctctccttaattctgaagcacagcttagccaggtacagtattcttggttggtgatttttttctctttcagcactctgaatgtatcatctcactctctcctggcctgtaaggtttctgctgagaagtctactgccagtctttctggaactcccttatatgttatttgcttcttttctcctgctttcatgatcctctttttgtctttgatttttgacagtttgattatagtatgtcttggtgtagtcttgtttggattgaatctgagtgtagattgttggccttcctgtacctggatatttatatctttccctagatttggaaagttttctgcttttacttctttaaataagcttactgagcctttgactctcttcttcaattcagttcaaatatttgctgttttgatgctgtcccataaatcccagaaacttcctttgttccttttcttttttctcctctgtatattttcaaataacctgcctttaatgttacagatttttacttctgcttgagcagttctgctgctgatgctctctattgcatttttcatttaactcattgtatatttcagcttcagaatatttgtttgaattttaaaagatactttcattttttctgttgtttctcattttgatcatttattgttttcttgactttattgaattatttctctgcatttaagtttccttaaaacaattattttgaattctgtgtcagacagttcatatatctccattttggcagggggcagctcctaggagatcttttgtgttcttttggtggtattatgtctctttgtttttcatgttttttgttgctttatgttaataatctgtgcatttgaagaagtaaggacttattccagactttgcatactgggattttctggggaagcctttcaccagtcagctcatccagagatccagagattctgagcaggtcatctggtgtggtcctctggcagacttactactggagcccttggactttgtgcctggatcagcaggtgggtgggcctggtacctgggtctctgggtctgtcgggttggacctggagccttggatcccctgttcattggatctgtaagggtaggtctggagcccgtatcctcagaggttgatctgaagcctggggggctgacctggtcctggggtaggtcttgagtgtgaccttgagaggctgaccacgtactgggatgggcctggtacccaagtctgcagggttggtcctggggtaggtcttgagtgtgagtctacagaggctgaccacgtactgggatgggcctggtacctaagtctgcagggttggtcctggagccttggttcatgggtccagcttgtcagcagggtctgctgggctgggcctggaccctgggtctgctggagcatggggctgcagggactttattctgttcttctctcttgctgtcttttttttatgattaggtggttttctctagtggtatgctttgatttcttactgcagggaccagattggcactgggaaatcttgaagcctatgtccagagttgccagcctggtgcctcagacccagtccaatgacaggttagccagctgaatgacagacccatcccctgtcactgggctgggtctgaagtctggggctgtggtctgaagtctggggctgtgtagggcaatctggccctgggatggtctgaaacccggggtggaacctggggtcatagaggctggcctggtgctgggtggcatggagcctatacctgcagaggctggcctcatgactagggctgcagggccagcttggtagcttgggtgggcatgaagtctggggctaatggggctgttggggttggcctggtggtggggcaggtccagagacagcctgccaggctagcctagagcctggggctgcaggatcctgcctggtgctgggaaagactcggaggctcagtccacagatagttaccatcctggaacctggaacctggaacctcaggggctggcctggcactgggtgggcctggagcctgtatctgcagtcaggaagcagggtctgcaggtgcaagcctgatgacaggctgcaggggatagcctggtgctggcttttattgaggcaagcttcattttgccggcagatccaaagcaaagtctagtgcttatttctctctccttcccccatactgaggataccttgctttaagctgtgctgcctggggttgggagtggggtgatgcaagtgatgtcaaactgtccttcctaccttcttcaatgctacatccaggtgctgtaatctctcacttggtttccttagttcttgtgaaaggtgtttttctatgtggatggtagttcagattgatatttctcttgggtgggggtgatgtgtactggaaagtcctattcctccatttctttatatctgtctcaaattgtcccagatttacagatgaagaaactaaagttcagcaaacttgaatatcttgccaatgacacaaaactatttagtagagccaaggttcaaacttcagtctttgtgaattcagaggttgcttgcttccactgtgcagatgtggaatatcaaactagtctttagattctgcgagatttttctttctctcttatgttctaagaaatgggaggtagaaaagaacagtgatgggtgagggagaactgtccttgagtctgcaccctccacaggaattttgttgctggggaaggttggggaggggctgtggagagagggtccttagtgcccagctgaaagtatttttcccactggagtggttccagatttaccaaactgccatgaaacttgcaaccaaggtgtgacactacccctggctacaattgtctaccgttgccaggcctttggaaactgctgcttttgccaccagggcctttgtgcaaaagggcactttgctttctgtccctgtggccatcaccagcttcccattgatagctcctgtctataactgttggggtttaccatccaacaagcggactctatatcagctctcttcacctgtgttgtcttgtatgttgctgtgtgtctaaggtgtgataatttgccctttcttcacttgtttttcatagctgtctaatttatattgttttgagtaccaggactgtgcagtgggctccagaactttctccaaagggaatctgttgccatttaactggggctgttctagtgtgtgctacccaagaatgcccctttatatgctttttaaaaatcttaattcaaaaatacattttttgtgaaaaatacaaaaaagaataaaataattaccacccaaagacaacttgctaaatttagtatatattattccaacattttctacatttatgtatatatattacataaagaaaacatactttttaagtaaaatggcttgttttgtacctatagcttagtgtcctgactttctctcgaaaccatctttcataccattaaatattttccatatcgtttagtagtaaaattgttcagctaatcctctattaaggttgtttctcacctctctgatgttgtaaacagttctgtggtaagagttgatgtagctaattctttgtgcaccttcttaaatattgtacttttctcccctttctggtttattttttaagtaatatgtataaatgagggaagtaactaagttgctctccctactgatccacagggtcatgatttctttagggtacatttctagtattttaattgttggatcaaaaagtatgcaaaattttaagtcatttgcattttagaaaggttatgtaagtttactcttttaccaataactgaacacctttgtggacaatggatattttcatttcagattttgtcaacttcataggtgaaaaacgaatctcatttttttaacttatatttttaaattgctagtgaagttgaacgtcttttttatttacaaattggtcatttggatgtttcttattttgtaaattgcctgtttgttttttcctgttttttaccattgatgtgtttatgtgttcctattgatttgtaagagttctctaggggaggggacttggatttaagaatattaacaatttgggtgtcataaatattagttactccccccagttgttttgtttttattttatttgtgatattttaaaatattattcaaggttacaaaagatgtaatagttaaaaatgaaaagtataatcatgctgttttcttattttctacctaacagcattagaaaatatacaattctttatatttttgttttagcaatagaaaatttctatgcacttcttgatagaaaagatgtgaatttgacttaccctttcccatttgcctcttatcctattaatatttgatattttaaaaattctggttatttatccttatgacttgaagtaactcacctaattctattttgtactccattatcattcagcggcatctcttgactgtctactttataaaatgagaatattagcacctttatcccttcttaccccctcctccgcacccgcagactgagcccagagcatttccaggagtttcttcttcctccataatctacacaggacaggctttcatctccactgcagctctttcgctggttcatctcccagctggctctcatctgcttcctgtcgttccagcccgtctcttccctgttacaagttatcctccttgtacctccgtctttttatttaaatggttctctaaagatgaaaggcaaatgtgcctagcttgccatcttgagctgaacattgcagtgctttgtatatatagaaattttaaaatttttatgtggtgaaacctgcaagtgattccttttggtttccacctttgccgccatgtttagaaagtctttctccaatttaagattatgttttctttagtacttttgtgaattacttcttactttgaaatctttgttcatttctagaatttattttggtgggtagaatagtttagagattcatcttttgttcaaatggttagccaactactcagtatcatttattaaataatacaaagttttgaagtactgaattcttacatatatttgtgcccgttgctgagctttgcttctttaacctgtctctgatgcacactggtgccaaacttttaattattgccatttcagaattttaatatctggagggcaggtcttcaccaccatcccccgacatcattgttctttatcaaaatgtttttagctgatgttgtattctctcttccctgctgcaaaaggagtttactgtagtatacacgtttgaatgaggctgccttggtcagcccacgtcttagctcttcgtcagtatttctttctagctaggcagaaagagtaaaacttctgtgtaatactagttccctgttccacccaggttttgtattcacttgcttttaggtctaggactggagaatgcagtacatgccaataattctagtcttctctgatctgtgaacatataccttcactgacatttgtgtagttacttggagccaaaaggaaaattgtcacttagccagatttcactctcaacatttcacgtctccttccactacctgacacctgctagtacctcccagtcacccaatctgatctcctaatctctggcatctgacccagcctccatcactgcctccctcaggaatgtgtagatggccttcaggccatttcgtcaggctccctctttcccaccctacctgccagtctatccttcgcctgcctgccttcctttccgggtgccagcacaaagtttgtgacctcaggtgcctttgtgctcaggcagaattaggcacctagcaatttacgaaacactcatggctgggtgcagtggctgacgcctgtaattgcaacactttgggaggccgaggcaggtggatcacgaggtcaggagttccagaccagcctgagcaacatggtgaaaccccgtctctactaaaaatacaaaaattagctgggggtagaggtgcgtgcctatactcccagctactcaggaagccgaggcaggagaaatcgcttgaacccgggaggccgaggttgcagtgacctgagatcgtgccactgcactccagcctgggcaacagagcgagactccgtctcaaaaaaagaaaaaaaaaaaaagaaatacttatttaattatgcttacctagaaacattgcagcatcaacataactggctccagccagaagaatgagtacttgtttcctggcgggaaggatgccaagaaacctatgcttcggagtctctgtgggcacagagcctgtgtttgaggcagatggaatttcatccgtcggaaatttaccgtcattgactctttcctaaacatacttagagctaactgaaaaatggtcacctttgcacttttgcacaaatctctatcaaaagccagggagaacagaaaatctcttttactacttttttattttcctttttttttggaaacagggtcttgctctgtcgcccaggctgaagtgagatggcgccattttggctcactgcagctgccgcctcccgagtcctagcgatccacctgcctcggcctcccaagcagctgggactacaggctaaatttttttttttgtagacacggggtttcaccacgttgcccaagctggtctggaactctgggctcaagcgatccgcccacctcggcctcgcagcgtactaggattgcaggggtgagccaccatgcctggcctactttttccttttacgtttgctgatttttgtcccatccttctttttgattctgcaacaaaaaaattaaaatgttaaatattaaatatcttttgtagaagatactttattaaaattctatttcagtgctatcaagtggaaaaataaatgcaagtcacatttataattgtaaattttctagtagccatattaaaaatagctttaaaaacccaggtgaaattaattttaacatttaagctagtgtattcaaaagaatgtatcagcgtgtaatcaatcttaaaaaatattgagatgccttacattcttttttttttccatttgatatctgatgtgtattttatacttccagtacatctcaatttgggccagccacatctcaagtactcaatagctacatatgaaatcactttacctccaaattctgagtgattttactagtgactttatattggaaataaccacatctagaagttcttatctagggatgcatgttcagaatcacctggaagctttttctaaatatgcattcctgcctgtaccctcactagatctgttaaggtaaaaatctctgctctgtgtgagcctgggcatgtgtgtcttgagaaaggtacataggtgatattgacaagtacatttaattaaaaaccactaagatgatccagcttcttcagtctacctatgactaaacacgtcctgtgtgatcaaacagctttcccacagagagtaatgatacagacctcagtcttccattcacaaatctggtgtcctttttgcctcatcatttctaacatataggataagaatgtagactaatattatacacagatttgttcaataacaagagtcagcaacaaaagggagtttcaagttactctttagattatcaggaaatttaatgtaaaatatcctacctgcacatgtgtgcacgagcacgtgtgcacacacacacacattgtctaaatagtcttgttaattgaagtttcattgtgatgggcatgaccgtgtagattttatatgcatttccatgttcttgataccttttagactcacctcatagattatacttttctgaaactgcttttaaaaatctatatcaaaatagataccaagggctattataattattttagtatatctctggacatcataaccaaatacaaaagttcttcagcctgtcagttttcaaagtgtcagctctggatttttcaggttaaaatttcatatctttaataacaaggctgccagatatcagcaggcagtgtggttgactactctgtaatttaatgggagttcttcataggtgagtcacagtggctttcttctctttctttcacatggtgctgacaaggacagcacacgtgctatactgaaagatagtaagtctcagaaaggtcatccaaaggtaatttgtggattatttttgatgagttggagatatggagaaaaatgtttgctctttaacacttaattttgtatgaagtgaccaaacttagattatctagttttatttcatgcaagtgaatttaacaattaaatattttcatagttctttaatccgtatgcttattaaaaatcaacttaagtctacaaaagtcacaagtaattaacaagcctgttaaataaaataatgatatccataatagcctacaaataactactagaatttttaaaaagcattttaaaggtccaaaacgtttaaacaggttatttagcagtaatcaggatggttatatgacactcacttgaaagaggcttcagtttagattatctagactaactgtctttttacaaatggaaaattcagagagatccaaagagatgaagggattaactccactcacatagagattcccttccagtgctagtttgccactgtcttctgactcacttcagttggctttttttttttttatcagctatgatgactttcttttgctagaatgtaatatcatgttaaggtatagtgatttgcttataataaaatgatttaaaatattttgacacatgtctattggacatatcaatacaacagaacaaagacaatagccccatgacttcagtgcttcagagttccatgtgtgtttccttccgtgtgtctaacataggacattaaagagcatgatcatttcttcaaaaataggttccttcaagctgagtacaagatccaaattttaaaaataccttttgtggaaaatactaaaacttggaaccacaaccttgtttctctcttttaacgtaattgctcacttcatgaaaaaaaaatcccctttggacaaatggatgtaattgtatatgtaatgcactgggaagtatgagttactattgattaacttgtattaaatatctgagaaaaaggtatgtattttatttgtaattttaagttgacgagatgataaatagaaaaccccttatttggagttccctgatgtattcttagtggtcaagacccttaaaacaaaaaatgtgatttctcgttttacattctcctcctttctagtttttttttccttcttatgcagaacagagattttattgtagaattaaaactgataaacctgatccctcagctctgtgctattttgtttaccccatgaggagttgctccccataaacctgagagtttgttagaaggtaccttgttcagaagattatcaggtttaagcaattgccattcaagagagtaaagaagaactagtctggaagctggcaagaaaaaaaaagttgttatttctaagtcaatgtttgtagaacaattgcctggttaggcaatgagacagtagtgtttaatacaattgagctgtggtgtataatatgagtagtcatacactcttttgtaagagtcttggattgatatttttgttatactttgcaatcaaataaaggaggctgtttgcacatatcctgaaaacgatttgataactatatagtgattatttctcggtaatttttgaaggtctactaaccaaaaaattctaataaaattcactcttatgaaattaaagattaagtcacaaaaatacaactgtttagataaatattcaagcactgacaggcatatagcacctcagttctgtttgtttgctggccattatgtttttaccagcttttgttttaaaagtctcatctttctccttgattaaattaaatgaacatcctttcctgttactccaaaggattccttataatttttttatagcacctttgattttagactgagggcttttagatagacttaaatagattcttctactgtatgtttctgaaatattggcccctgtactttaccaacatacatttcactttataaagttaatgtaagggcttttcagtgactccaggcaaacctcaaacaatctctgatttgcaaaaagatcaagatgcctctggaaataacacacaacccagtgttgttattattatttttttgcaagacctaactagagaagtgatcattatactgtatattctttaatcttgatgtttttaaagaagtttaagtgttgtatcctttaagcaattaagttcagttcaaaagacagaataaatacaaagctctttaaaaaaaaaaaaaacccttaagagaccacattgtggtaagtatttcagcctctggattttgataaactagaaagctttattttgaggagtcattaacttgcaatttggcccagatcactctgtaaggtcatggtagcttcagaccccttatctctaactagcctgcccgctgggacagaaagtgtgttccaagagaaagagcaagatctctatgattagattgagtctacaggggactgagagccctaagaaaacttcagattttaagaaatcttcaaagagaaaagagacttaacagatccagatgagccatgggaacagtgaagtgcttggtgcatgtatatataagttctcaatagagctgtttcaaccactagtccaaattcaacttctcaagcctggtagagtcaaatttctggcacttggcagcagagagtttatagaatgccttgatggaatcaagtagtaacctgtcttccttgtcttccttttgcttccaaacttatgacttggatttttttttttttttaatgctctttccagccctagtagtgacagcattttccaaaatgttactcaaaacctctcaaatagcagaggcagtaccaacacatcctggcatctagcctacggtcgtgcttcaggaatacactgactgccttggtgatggccaaatgccagttcttatagttaagttgtggcttggacatgtggacccattcctttctgtaatcctatcatgatcccctgctttctttcttccctaccagaatctaagctcctggaaagcaaatgctatgacttttatctcttgtattcccacagccatgttggctagaaatatggtggatacacaaagaaagttagttgaaagaacaaatccaactatccaagaggttctgaatacccactggccccaccaccaacctctgctcttcttcttcttttttttttttttttgatatggagtcttgttctgtcgcccaggctggagagcagtggtgtgatctcggctcactgcaatatccgtctcctggattcaagcgattctcctgcctctaccttccaagtagcagtgattacaggcgtgtgccaccatgcctggctactttttgtatttttagtagagacgggggttcaccatgttgcccaggctggtcttgaactcctgacctcaggtgatccgctgcctcggcctttcgaagtgctgggattgcaggtgtcagccaccatacccggcctgctgttctccttttaatgcacccaagtcctggggaacccgactggggatcagagctgtgagctgggggagggcccgttgttttgaccctaagacctagcctgacttgagaagtttcaggatgtggaatttcatcaggctcaaggaatcctttcaaggagcattctgacaatagaaccatataaaatccactcttctttttgtcaattattttgaaactgttccagtaattaagattgagctagaaaatatgaactacatttttacaaatactcagaccttcaaaacaggctttaaaaggccgggtgcagtggttcacgcccgtaatcccagcactttgggaggccaaggcggcagattgcttgagcccaggagttcgagaccagcctgggcaacatggtgaaaccccttctctctctaaaaataaaaaaataaaaataaagaaatcagccgggcatggcagcatgggcctgtagtcccagctacttgggaggctgaggtgggaggatggcttgagcctgaaaagcagatgttgcagtgagctgcgatcacacactccagcctgggtgacagagcaagactctgtctaaaaaaaagcccacaagctggctttaaagtgaactaataatgatgtctatgttatgattctatatgatatttgaatatgttcacccttttctcttttaatattgtttcaactactgatttactttagcaaacactttcttcattaaaagtgcaaaggtaaacttaaaccatccaaataatcagccaaatcagtcgaatctacatgaaatatacaacaatctaaatgcttaaaatagataagtacaatagtggagggcgtaatgtgttactgggcttttgacatcaaggacgtctgtgttcgaatcctgactttgtcagttgttagtaccagttgtattgacttagataaatcatttcacctttccaagtctcagtgttttcttttataaaaactatggttgtcaggaggattttgtgagataattatatatgaaagaacctactaggatgtattctttagtaaacattcagtatttggctctctatttggcaactgagtggtggttgtgttccccaggtgtgagggttcctgggctgggctggggctactgtcttgtagtttcagtaatttggtttcttgtgtactattcatatatatatatatatatatatttttttttttttttttttggagacggagtctcactcttgtcccccaggctggagtgcaatggcgcaatctcggctcactgcaacctctgcctcccagcttcaagtgattctcctgtctcagcctcccgagtagctgggactacaggtacctgccaccacgcctggctaatttttgtatttttagtagagacgaggtttcaccatgttggccaggctgatcttgaactcctgacctcgggtgatccgcctgcctcggcctcccaaagtgctgggattacaggtgtgagccaccatgcctggcccttattatatatttttatatactttagaaaatttgatctgcggaaaatctggttcttgttttttggccacattatcagatcagtcactcatctactgtaagtacattaaaaagaatacatggtcactttgcccagttaaccagagaatggtgccattaagttaaaaaatgcatatacatgtataggcatgatcctcatatagattagttttgttagctgcacagtcacagatcaaatcctgagttattacccttcttacagaagggtgtgtcgcttgttcatggtggggacaaggttgtcagtgaggatagcttgatagtaataaactattactaccattggaagaacatttcaaaatacaatattatgcatcctacttaggttattttcacttcatatggtaatagtccattaatttaccctaataatatttagtagattttgacatctactagaacataaggttgaagtgaaaagcatgttttagtttgtgcattttaaaacaattttctacgaaagaaaaccaaaattaccttccatagctttcttatttaaattggacttaatatttctattgtttttaagattcaactcttggaatcttctacatttctttgcctaagtaataggggatggtttatgttttttgccattcataatttttcttaaaccttcatacccacatttagccatatgcgctttaagacacacagtgaagatgaaatttaatacacatcaaacttctgtgcagacttggtgagaaacagatattttgcagcctgctttcactctgtgagtcattaaggagtgggttgataaacttgcattgcaaccttgcttatagaagattgtgcctattgtaagatactccctataaagccaaaagataaaaaaatgctaagggtactgacaattgtttataaaatacagtcataaagacatcccgctccagagagttctctgattaaacttcacaataactgtaatttctctgcctgaatcactttgttaaattttgtcttggcttctggagacagggtagggagacagattaaatttcaataccttatgctattcattgggcttgggagagtttcttcagcataaatgataataaagatagattagtgattctggtttatcctctaatcttagcatagacattttctgtagattagaagtcatttcatttatgaaccaaataaggcttctgatataaaaagaaaaatgaatcttactcagttccctaaggcttagaaaagattgctggaatttaggagttgggtaaatggttttactttagctactaatccaattgaaaaaacgtgagacgattttctgaaaagctaaaaagctcttatagtaaatttgagaggatttttaaattatggagaacaagatagtattgcccttacctaaaattctccctcaatattttgtttcctttgctttggaaacagcatccaagcagggccactgagaagggtgtgtgggggtgggtgttttattgacagttgtttgaaggaaattatgcacaggtacctaaaaagagcaactcaggcaagtttcccagccacttagatttcctgtttctttaagttaagcattgctattcacattgtgttgactgtagaaggattgatagtgtccagtacaaataataatagtaaaatagaatttctgcttagagtttgtggtaaatatcaaaatatcttagtgataagcacatgtattcttttaaattttgtcagttgcccagtgcttccattcattcatcacttgtttattttattcaaccagcatttattgaccccctgctggttctgggtttcctctcatactgtgctagatgcctggtatgcaaagataaatgagtcatggtctctcccctcaagcagtcaccaactactaaattcttggtcattttagttgttttcttttttcttaaaaaaattttttttttcaacaggtttttgggtacaagtggtgtttgtttacatgaataagttctttagtggtgatttccaagattttggtgcacctatcatctgagcaatgtcactgtagccaatgtgtagtcttttatccctctcctccctcccagtctttcccgagtccccaaagtccattatatcattcttatgcttttgtgtcctcttagcttagctctcacttatgagtgagagcatatgatgtttggctttccattcctgagttacttcacttacttaccctccagttgcatccaggttgctgcaaatgccattatttcattcctttttatgtctgagtagtgttccatggtgtgtgtgtgtgtgtgtatacatacacatacataccacggtttctttatccactcgttgattgatgggcatttgggctggttccatgtttttgcaattgcgaattgtgctgctataaatatgtgtgcaggtatctttttctataatgacttcttttcctctgggtacatacccaggtgtgggattgctggatcaaatggtagttctacttttagttctttaaggaatctccacactgttttccacagtggttgtactagtttacattcccaccaacagagtaaaagtgttcccttttcaccacatccatgccaatatctattattgtttgatttttttgattacggtaattcttgcaggaataaggtggtatcacattgtggttttgatttgcatttccctcataattagtgatatcgagcattttttcattttttttggccatttgtgtatcttcttttgagaattgtctgttcgtttccttagcctactttttaatgggattgtttgtttttttcttgctgatttgtgtgagttccttgtagattctggatattagtcctttgttggatgtatagattgtgaagattttctcccactctgtgggttgtctgtttactctgctaattatttcttttgctgtgcagaagctttttagttcaattaagtcctgtgtatttatctttgtttttgttgcatttgcttttgggtccttagtcatgaagtctttgcctaacaaagctattgtctagaaagttttcccagggttatcttctagaatttttgtggttttggatcttagatttaagtctttgatctatcttgagttgatttttgtataaggtgagagatgaggaaccagcttcattcttttacatgtgatttgccatttagcaccatttgttgaatacagtgtcctttccccactttatgtttttgtttgctttgttgaagatcagttgactgtaagtatttggctttatttctgggttttctattctgttctgttgttctatatgcctatttttataccagtatcattgctgttttggtgactgtgatctcatggtatagtttgaagttgggaaatgtaatacctccagatttgttcttttgcttagtcttgcattggctatgcgagctcttttttggttttatttctttttttaaaaaaattattattatactttaagttttagggtacatgtgcacaatgtgcaggttagttacatacgtatacatgtgacatgctggtgcgctgcacccattaactcgtcatctagcattaggtatatcttccagtgctatccctcccccctccccccaccccacaacagtccccagagtgtgatgttccccttcctgtgtccacgtgttctcattgttcagttcccacctatgagtgagaatatgcggtgtttggtttcttgttcttgcgatggtttactgagaatgataatttccaacttcatccatgtccctacaaaggacgtgaactcatcattttttatggctgcatagtactccatggtgtatatgtgctacattttcttaatccagtctatcattgttggacatttgggttggttccaagtctttgctattgtggatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtgatggtgagcattttttcatttgtttcttggctgcataaatgtcttctattatttcaggagatctactagatgctggagttacagcagaagaaagacaggaagagtttcttcccttatggagttattctctagcctaggaataaaagtcaacatgaataaaatggagaagcaatcaatgctgagctgaatttttcaaatagagtagagctattaatcatattaggtcagagatgtaattctttggtgagagactaataaatgaaataaaattataggtctttttgagactaattgaaattatggaacaaccgatagaataaaactacattctaaaattgtagtttccagattcagacttagaacattccttaattaacttagcatttgatttatagagaactttaatatttcaatagtattatctatcaaatagttaatgaactattttaactttctttgagaaagttaaaaggcagatatctccagttttaacattcggctctgactcaaattttggttaagttttgctgtcacatctagactttattacataaacaaagatttaaattaattacagttacttcaatgggatatataattcagatttattcaactttccccattctttaattactactggtcagagattgttcttgtgagagatacactattttagcatgactcagaaaccttagtaacaaagtgaacattttaaaagcatacaaaatacaagcccgaattcgattcagaaggcataaaattaagctattggatgctgtagtttctcagtgctggtgtgactctctgcccctgcctcatgatagaactaggaaccataacagttcactgagtcatgctaggccatggtatcagcgcgtgcttggcagaccctcagtaaacctttgtgtgagtgggggcatttgttgcacagtgatgatctcaacattactttaataatctataccacatatttatgcttggtattggtttgttttaaaatgcaatttttaatttaattttattattattattttttgagatggagtctcgctctgacccccaggctggagtgcaatgacgtgatgtcggctcactgcaacctctacctcttgggttctaggattctcctgcctcagtctcctgagtagctaggattacaggtgtccaccaccatgtccgactaattgttgtatttttagtagaggcagggttttgccatgttggccaggctggtcttgaactccaaaatcagctattctttaaaaattatgcatttgaaacaatgaagatttagccattctaaacacttctttagaaactttatgcctgcccttccttaatcgattacatttagatggaacttttgtataaagtgttctcctacacatgatctcatttgatcttcttgacagttctgtgactgatattggacacttattattatccccattttatcaatgagttaattgctatttacctgcgattatatagctaattaatggaaggcattggctgtacaatgggatttgtgactcccactttacagctgagctcaattctttctaccattgacctgcaacgatgttttaaataaaatgactactaaggttagatgttttaaataaaatgactattaaggttagatgttttaaataaaatgactactaaggttagactgctaaggttagaggttagactgctagtttctgccaatggatcatttttgccaataataggataattttttttcacaataagaatcctaaaaaaaaatttcatcctagcctcagcacttctctacattaattctaggaaacacttgtacttagatggagcttcctaaggaccagcaatctttttaacaaaagatgagcccttcaaaagctgcctgataagtgagtgcaagaattataaccattgatacacactgtagtcatcaaaaagtcagatcacacagtctattctgcataggactccattcattgccttttaaatgcaataaacttcccctccctttttcacaccatatcctgcctttttctaacctatattaatgattcaatacatatggtgaataaattaagtgatagagtttttttaattagcaagatttttatatagcaagatataacctgagttatacctgtatttcactttgatctaagagaagcaaatcatactagctcttatataaaaactctgtaatggtagcataactattcagtaatgttactaaatgaaaaagaactgcacaatgcattttgttatgcatattttctttaggaattccttcactcttggaataaacttaactcttttccataaatgagacccccaccccccgcagtccaaaatttgtcaagctgaatgatcactaaaatcacctaaagaacatttttaatgttatttttctcaagctttttataactaaaattttcttcccatatacaaaaagctgaaagactagtacaatgaacattcatacaagtacctcctaaattcaatagctgttaatattttaacaaatttggtttctctctctgcctttctctccctctgtgtgtatatacatagacctatctgtataagtcttggcttgatttgagtttaggtaaaacattattgataaaaatacttcttcattgatgtgtgtacttcatattgcattacatcaggtggcaaatgacgtcaggttgtttcatcgctggtaattgtatttaatcatttgttcatggtggtaagtagcagatctctttttttttgtaaataacaaacgtgtctggatggtagtttggtactatgtgaatatcctgttgctaacatttcacctaaaggaaaccatccttttgtccctaccagaatctattgttccatcagactctgttgttacatctacattgattagctggccttcttctgtaaaggtgagcatttctttatcaactgtgggtcgactacagtttcttctaaaaagttagggtaatttgtaatccttcccctttaccacgtttcgagtagatctcaccatatcgaatttttcccattattttttcagggctacttttctttctgacacaactaaatttgctcaccttccaatttcctgcctcagaccccaaatcaaccatttcttcaaggaacctcagttctttttagtgaaggatggtatgtataaatcaagctctaagtgttaggcatacctattgtacttgtatctttgcttcttgaccttttcagtggacagtgcaaggaaatatgtgtatttctcttaatcatgagttcatgttagtatttgtaatttaaatttaacattaattttaaaaattatatttgtatatcacacttaaaacttgcaatatatttatttgattcatatatacatatatagttttgaattacaataaaattctgaacgaagtttaagatttctttgcaattctttctgtccctggggagtttttaaaaatgcaaatattggccgggcgcggtggctcacgcctgtaatcccagcactttgggaggccgaggcgggcggatcacgaggtcaggagatccagaccatcctggctaacacggtgaaaccccgtctctactaaaaattaaaaaaaaaattagccaggcgtggtggcgcgcgcctgtagtcccagctactcgggaggctgaggcaggagaatggtgtgaacccgggaggcggagcttgcagtgagccgaaattgtgccactgcactctagcctggacgacagagcgagactctgtctcaaaaaataataataataataataataataataataattataattatatctgtgcccacttccccaagatcttctgaattagaatcctggagatagaattttgtcagattgtaggtttgtatttttaaaataaccaatccatgatctcctgccctagtcagcctcaggactgctggaatatgtgaaatctgttttactttgggtcatatctctcaatcctccctcccctcttttttccttcttagacatttttataattttgttataatgtaattacagaattactgggcacagggagaaatgtttaaggaaatgggaaaagggttgactgggaagtaaaaagaaaaatcaagaatttgcaggaagatggtatagggagcttagaagctactggcatgaacagtaacttttcataggctatcattatcctcaatatcttccttacagttcttcagaagattttaaacagtaatcctgttttttaaaacaggatttaaaacattatttaataatggcctagcatttattgcatatttagcattgccaggcactcaaagtattttatgtagtgcctcatttaatccttgcaggaaccttattgtgctcatatattaatattccaattttgtaaatgaggaaactgacttaaatatatgtactctgcttaatgagctactttctaaggaaaacacaagttttatctttgccacaggttgggttacccaggaagcgcactctgagattgagatttggatgccttatgttgttagagatacctgacagatctaacagaattgatctctggggatcaatacctttggaagggaggagatgcaaccacaaccactcagtgaagctgagctatgaagtggttctctaccaagtcctgaaccaaccccacagagagctctggagctagggtagttgttcaaagtccttccaatttggagcaagaggactggcctttttacctctgcattgacccatcgctgtgtgcagactgcccctggaaggaggcttgatcttggatggggaccctcttctgctggcactctctgcagccaggggaataagttttttaatcctgaaagggcttctggggtagaactgatcgctgatcacagtgtccaccacatctccagtaaatttgctataatttcttcaaaacaaattttcttgataaagactttttccctattggctattcttttcttatttttcccattgaagaatatatatatttagaggcatttgctcttatgtcattcaccataaactcaaagtcttttttaacccagttgtaccagcttttaactccgtgccttatattacatcggataaaccaaaatatttttatgcagtaacttgctgttttttttaaacatcaggcgtttagcatctccagtcctcaacattttactctgcttgtctttacagccattcttgagaaggttctcaaagaggtcaatgcaagagaaagtcttcatattaatccatgcttaggatctcctcaatttcaaccccttctttgttaaagcgtcctctttgacactcagcatacatccttcatcccgtgattttctggtggagaaaattactcactctcagcttgctggctgactgtcccaactgtctgtcttctgtgtgaacttggaggcagaagggctgtgtgtgctatcactccctggtgtagagaaacacgtccacctcctcctgcctctggtgtacctggtcccttgtatatgggattatgtgctctcagcataagaaatgcctgatttttccatttaaatgaggtgaggctatgttacaaatgcactatttgttctcttcttcctttgggagtatttctggtcttcatttttattggaagacctcgaaatactttaaatatgtttgttctatagtttttaaaaaataaatcatttctgagtatgttgaaactcagtacccagcaacataattttctttggttaataatttttctaaactggaaatgaaatgccttaaaattatgcatttgtcaaatatgctttaatatgtggttaaaagccaatctaataaggaaaaataacctaaaaattagtccaaccattccttttaattccttgcttccaatttaccatgtatatctaccactttggagagaaaaactgttaatttaaccttaatttttaatttaatttaaaaattttaaaatgtaactccatttaaagaagtatcttgaggaagattgaacctgggagcaggtaagtaggagagatcactaaagagcaaagtgtaaggtagagcatttgtttccttcttttttgtttgtttgtttttgtttttgttttgagacagtgtctcgctctgtcgcccaggctggagtgcagtgactcgatcttggctcactgcaagctccgcctcccaggttcacgccattctcctgcctcagcctccccagtagctgggactacaggcacccacgaccacacctggctaattttttttatttttagtagagacggggtttcaccgtgttagccaagatggtctcgatctcctgacctcatgatccacccacttcggcctcccaaagtgttgggattacaggcctgagccaacactcctggcctccttcttttttataaggatgtgtgcctcttcacatagagtgctgtgtaggacttgaacttctatctcatgaatgtctcatgttggcggaggtcatgcagcatgattctcattgcttttaagtgatggataattgagtgattaataattgatttcactgcattctgtgttttttgcaccttttaaaaaaaatcgcttaagctagggtttttgtttctgttttttaaatgctaccccaagtttggttgtgttctcaagtgaaaaacattgctagctatgccgtgtgtgaactttcagcctagtcattttgtggccataaatattgtttctatgagcctcttttcagctgtgctagtcatgtgttttctgtttgttccttaaattatgtaaaatgacccctttggcagccaacaaattttatagcttactatgataaagagcttccttatggaaaaaatattcaagttatataaaatgttttctagcaggtcaatttttttctgaataaatagttttaaaaacaaatttaacaggaagcttaacaattttttgaaaatttgtacaagcagtgctcaatgtagggaataaggaaaaccaagagatgagaaaaattaacacccaaaagctcatcaccagagaaaactgcttttactctctcttcttctagtcatttctatgccccattattatttttgcatatttgaggtgatgtggtgtaaacagtatgtatattcaatgtgtatattctacttcttcaaactaatattatatataaagattttctacaaaaattattttttgaacgttttataattatatactattcagttgtgttaagttcagttagcataatttttctaactgttctcattaagggcattttgtttgtttctagtagattggctagtatacaggctgcagtgagcatttctgcataatgtctcttctgtaattagaattgtgtccctagaatatattcacaggtctgaaattttgcagtcaggaggaatgaatgcttttaaagattttgatactcacagccagatggctttacaaaaaaaactctaccaacattaaattgtttttactttttttccccgcctaggagggtctaagatctttgtgaccctaaaaaggttaagagccactggtatgtttatgaaaaacagattttatgcttcttgaggtcatcactgccttttaacttccaggaaccctaccagtaagcataccctgaagtagatgtgcaagaaatttgttgaaaataatgatcttagtgagatctgcatgtgaccaaaattgaggatgcctttcaggaatactaacatgccttaggcagtggaaagggtggccaactcctctttggtgtcaatttgaaaaccttattttatttacttcatattgtcagtggcagacaacagatttttgaagaccattttgtgtttttgcaaaatcacaatagcaagcacggtagctcagtttaatggtcctatgtgccaaagtgactagctgaaaataaagtatttcatttttatctgtagcagtcaagtcacatgagatgagtatatcatttcctgcatattacaatttattacatcttaatattcacctaccctagtgggcgtcatagtaagtttttacttctattacagtagcctttcctgagctgctttattatgaattctagttagtagtattttattggtttgaaaataaaggaaatttttattgaaataaatgtattgaaattaacagtgattctaaggaatatatttgttttagcatttaaatagtctacaaagataactatcaatttatttagctagaagttccctagaaattctagttaaggatatgaaaagcatggatgcctccctcgacctagagagagtataatagttaagaacatggaatctgtagccagagaccttggatttgaatcctacctttactgcctccttggagcacggcttttatcaagttacttaaactctgtgcctctgatttcttaactgtaaaatggggtaatagtggtatctagctcaaagagttgttgcaggaattaaaagagatacgtatgatgcaggcagaatcatgcttgtttcattgtatgggttcttctaccttctcctcatcgtattatcgtagtctttgtagtcgtcttcatgatggaagtcagtattcaatgaaatactttctctgataaattgatttactactttttttttcatttttatctccatttttcttggtaagcctttggaggttctgttccaactttgacaatgctttgactgacacattggcaggctgtcttaagtgtgtgctatagtaacaacatgcttcctttttcatttatttgtagataccaggataaatgtgctgcttaccttcattataccaggtaaaagaagggaaccttttcaatagaaaacaaaaaacctgtatgacttagggtcatcagaagagtatggcaaaataaaactgagatattcagtgagacttgccagtgtagtcttccaataaattattgcatattatttgccagagcttcaccttttgttgcaaacagatagcaaatttcagttgcaccacttcagcagcttatgttcatcaactgaggttggttggaatgtgtcagaccagctaaatttaagcatatgttatatattctttcagttaatgggtagagttgcttcctgttgcttaactactgctatgtttccttctctcaaagtgccaaaaagtttttgaaataaaatgattattttaatggtttggtattgtgaacatggttatggtaaaattagaatattgcttctttcatctaaaaggtggtaggtagcaagatgaagaaatggaaatagaaagtaagggaaagttaaagttaactatcatatttttaatgttttaatatgagtataatctgtttactatataaatcagaaattaaattaggaaaacattccatattattctgtatgaaagtagtgttttgatatgtcactcctaatcctcacttgggtttcatagtgaacattttcatgtgtcctagaaaacagactgttggttgtatttctggataagtactctgtgaggggttttctccctttctctcactgatacctcttacattatgggaggggagaaaaatggaactctggtcttatatataatatagttagcatgtcctgggaaatatagtaaattattctgtgatagtgtaattatcttctgctgtctttatggaaccaggcatttgataaatttttggttagagtagaatatcagcaaagctataggaataggctcaattgtgaataatttagttttcctccatagccacagcactacttttgctcacaaaaaggcaagagtattcatgagcgatagtttgaacatctaaaaattcacagtagtacctcagttggaacagtctgcttaacataggttgaaaagcactttagtccttacttatgggacagactgatttaattctttgtatcaaatttttaaaaatgtttttccctttatttcacaagctgtcaggggaaatcatgacctaacacattgaaggaacaaaacacctttgacaggcagatctcattgtgcagtgtaagaattggcttctttggtgtaactggttgccaaagatagccttataacatgattttaaaaagcagaataaagagacattaaagtatatattaatcgcatgttttaaaggcccctcgagttaattgtttttgtaaatttctgggtttctacaaagtagaagtcattatcaagcagtcttcttgaagttgtttagcattgtggccaccagcacaggatcaggagtcacaggccagggttcaaacctacatcagtggcttactgattgtgtgacttaatgatgtatgatctcctctctaatctttggcttcctgaactataaaatgtgagagtaaaattacaggtcctgtctcactggatagttgcgaggattggagtatgtaacatacttaacggtgtctagtagttttattttttaaaatcaaaaattgcactgctgttgccccaaaaatccatctaaaaaacataaggcaggccctcctttaaatatatggaggccaggaaacatgtttcctgttgaataactgttattatttttgtatatgggagtagaaataaggaaactagaaatggcacagaatttaggagaaaggaagacacataacagaagctcttcctgtgcaaaaggagcaaaatactaagactctcctcaattagagctttttagtctggttggggaagaaaaactaacatataggacagttagagaattataaaaatattgagtagaaattcataagaggaaaaatatcactggaactagagcagatggtgggggctgagtctttataaatggaattggaactgaacttagaaggaagagaggaggaaagcagggcagtgctgtaggctaaggctggtaagtgagcaaaccctagaggcaggactgaaaataattttttaaaatcatctcctgaagggacgtgactgactaatgagtacagggacaccttgagtgagtacatagtgggtaacactgaagccaggcaaagagtttgagcctggttagggagactttcagtctcttaaaaaaaaaaaatccctgacatatactagaaagcagtggtttttataaatttttgattgatacatatgaattgtacatatttatggagggcatggtatattttgatacatgcatacagtgtgtaatgatcaaatcagggtaattaggatatctgttaccttgaactttttttttttttagagacagcgtcttgctctgttgcccgggctggagggcagtggcacgaccatagttcactgcagcctcgaactcctggcctcaagcaatcctcccacctcagccttccaagtaactgggactacagacacacaccaccatgccctgctgatttaaaaaaaatttttgtaaagatgggggtctctctatgctgccgaggcatgtctcaaactcctaccctcaagagatcctcctgcctcagcctcccagagtgctgggattacaggtgtgagcttgtaacattccttttctttgtgtcgggaatgcctcagatcttttcttctagctattttgaaatgtacaataaattgttgttccctatggtcaccctactgtggtactgaacactagaacttattccttctatctaagtgtatgtttgtacccattaaccaatctctctttacccctttccccttcccagccactgttagccatcattctactctacctcggtgagatccacttttttagctctcgcgtatgagtgagaacacgtggtatttgtctttccgtgcctggcttatttcacatagcatgatgaccttcacttccatccatgttgctgcaaatgacaggatttctttctgtggctgaatagtactccattgtgtgtatacataccacattttctttatccattcatccactgatggacacttaggttgattctgtatcttggctattgtgaatagtgcttcagtcaacatgacagtgcaggtatcctttgatatattaatttcctttcctttggataaatacccagtagtgggatgggtgggttgtatggtagttctatttttaggtttctgagaaacctccatactgttttccataatggctgttgtaacttacattctcaccaacagtgtataagagttcccttactctgcatgtttgccagcattgttattttttgtctttttgataagaacctttctgactcagatgagatgatacttcattgcggttttgatttggatttccctgatgattagtgatgttgagtattttttcatatatctgcagtatttaacagagctaagtctaaatgcaatatatagaatagattaaatgggagacactgttggattaattcagactgcagtggttgaggatttggatcccaaagaagagaacaatgccagtatctgcaccaattccatctttcctattacatcagaggggttgtccgcctcccagccaggccagtccccatgactgctttggctcccatcccttcttcattctcaagaactttgtgcacttgattaccccttctctcacatgctttttaatgtctcacccttgcctttgcttttaaaaatcttcaagcttttcctattaaaaacaaactaaattttctcattccacttcatatttcttccagctgcctcttcatctctattcatcccttaacaggcaaatcaaatttttcaaaaaatgttgtctattcttgtttgtatcgtttccacatctcccaactccacacttccactcactccagttgggctcttgacaccattaccctgccaaaacagctgtcactgaagttatcagtcagcttcaacttcacgttaccaaatgcaatcctcatcttgcttggcttctcgacatagttcaccgtgccctgtgtcttgaacacactgttttggtttttggttttctttccacatattgggctagtcatctgtctcttctatagtctcaccctcttccatccatcatgtaaggggtgaattcctcaaggcgggatccaagatcctctccttttctcactttataatctctccatcactcgtcttattggctcttgagtcaattattatctgcataaagatttgtgccaaattatattctccagtccagacctcttcactgagctataaattctgtttctgtctcctcttgaatgtttcagaagcacttgaaattcagcatatctaaaagggaactcatcatcttcaattctggtctatttcagtgtttcctctctcagtgaatagtatccagttgtataagttacaaatcttaaagtcattcttcatacctccctctccttcatcacacatatccaatccatcatgattggatagcaaaagaaaacagttgctcattttacttcgtaattactataatttgaatgtctgtcccctcaaacctcatgttgtaatttgagtcccaattttggaggtgaggcctaatgggaagtgattgggtcatggaggcagatccctcatgtattgtttcagtgccatcttcactgtaataagtgagttctcattctgttagttaccaaaagcactggttataaaacaaaacaaaagaaaacaaaaaaaaactggcacctccttctctctgtatcttgctccctgtctcgccatgtgatctctgcacacacctgcttcccttccctactgccatgcatggaagcagcctgaggccctatcagaaggagatgctggtaccatgcttcttatacagcctgcagaactgtgagccaaataaacctcttttctttataaattacgcagcttctggtatttctttatagcaatacaaatgggcgaagacactaattaacccttgaatctgtccactttccactttttttcttccaccaccaagattcttatccagactactgctgtctattctggaatctatcctcagtcactctggcctgtttccaggtctgttctcttactactcagccaggggattgttttcaaaatgcttctgtcccttccaaggtacattaaagctattaactcactttttactgctctcagatgaagtccagatgcattaccatggacaccaggcctggcttgatctagctactacctaatcttcagcctcaccttgccccaggcacgcctcactctgtactccagccatatctagtccttcttgcttggcataggccttccttctacaggcactttgcacaacacgttctctacctgggatactcttccctcctgtcttcacctaagtaacttctgttctttcagatctttgctcagtgatgtactcattctcaagaaagccttttcttttcttttcttttttttttttttcttgagacagagtcttgctctgttgtccaggctggagtgcagtggcacaatctctgctcactgcatgctccaccgcccaggttcacaccattctcctgcctcagcctcccaagtagctgggactacaggcacccaccaccacgcccagctaatttttgtatttttagaagagatggagtttcactgtgttagccaggatggtgtcgatctcctgacctcgtgatctgtctgccttggcctcccaaagtgctgggattacaggcgtgagccaccacgcccggccacaagaaagccttttctaacttcctaaattggatcaattctccttgaagtttcttacagcaccatgtttatatgattatttgtttatctgtctgccccactggacagaaagagccacaaaagcagggatgtatttgcttacctttgtatctctgtaacctggtacatagtaggtactcagtacatatttgttaaaccatcagttaggcatttgaaaggaatgtctagggcacagcaacaaggggatcacaaaaatgctttgtgtgctctagaaggtagaaagcagtatgacagatccatcctctagctgggtaggagagaaccgtgaggagtccagaggcctttctagttccatgctcctggggcctccaccgttgtctatcagagagctggcgagcgagccccactgcagcactgccattaccatacttccctggcctataccttcagactttgtcattcttgttacttcaacatcatgactgcagtttttagccctgttgaccactcctgccttgaaattctctcctactttgccttctgtagtattttatttttaagttttttcttatctctctgacaacatcttggcttctcttcccactcatttgctctatccgagtactcattccaaaattcagctttgatctcatggctcccatgtaagaggataaagtctgaacctctcagcagttcttaagagaccctctgaggaacttgccagtatctcaagtttcatctcctgcccttctgttatagcaaatgatttggcattctctaagcactccgtgtttttatgattttgtgccttttcctcatgccccaccttacatccccaccgcctatgtactggggagcctctactattttcaaaacgcagatcaggtcacttaggcctgctcaggcattcccttcctccaggctgtgactcccttagaggcaaggcctttttctataacatggcacttttatatagagtacctggcatatagtagacctgtaataaatattcggataacagaaaggacagttcttttatcttttaatgatgcatataaatagtaacctgaatgacaaataacactcatgataaaccagagtatcactgaataagcattccttcttgagaacagacctcttgatagttaaaaagtaaaatgtcaaaaagtttattacataaataaccttgatctactctgactgtatttttctgtctcacataattctgttacattgtcacaccctcctaaaatggatttctagtcgtgccatggtaataaaatgttgttctaggctttaaaatgatacatctgccctgaaagctttgaggtatttttttccctggggtggttattttttcagattgccaagagaaggttatcatataccaatcataatgtatgtgttgtaaagccacacattgcaatactttttttatgagctgttatgtaagccatgcttcagggcaaagcagggatgcagtggaggaagagccgttttatgcatttccagctgcacaaagtagtaacatttcatgtggcagtgctatattcattttcgagtttctcccctagagggataataggacattgcttttttgcctttcaaaagggtataacaaacattctctcccaacacaaatgccacatttgacctcattctgctctcagtcagtaaaatgtttttcttagtgtcataagaattattttctgttggtgactttaatttcctataaggtttttaggaaggtttggaaatcattatatggtttcactgggtttgccagatgtgaaggaggattaagaattaaactgtttgcttggctttggctggtattagattataaaatgcacttttattggaaacaagaatcaaaggataggcctaaataagtacttccctggattaaaaaaaaaaaaaaagtgttaacagtgtggtctccagggattgatattcggaatgctattttaaaatattttaaagagcatcgagaaaagagagagtcttagctcttctaggtactaaagtagggttgattggcacaagctgaaagttcactccaaaacattatgtgagtgggcagaagaggagcagatgtgacctcattttcaatcagttcagcttttaagccattcccctttctccacctgatgaaatgctgtggttattcttttgaagggtctgtttagcagggttaatttcttattatcctactaagccatttggtttttaaatgtatatttcctctctccatgtgcatacataatatatatgcatacataaattattcatatgtttaaaatttctcacagattttattttacaatctttctttcattactttgctttcattttttttctcttcactttcccaatacctttcttatttttagacagatcattttgtaggaataatgtggtaagatatttcttgtaaaatattgacttctattaaaatattttgtgtaatttatgatatctcatctttagaataaaaatgctacttaggagctttctttttaaaattcaggaattgcttagttcctaaacatgaagagttaaaatctactagagccttttattatttctaaaaagtataattatcagccttttagtagctatgagagatggactgttcagtggcattcatatgccttgtgtttataggcctgtcttgtcatacgtgctcttaccactgaaatgatggcataaactttgacaaatgcagttttatcaccttttgaaatatactacaaaacgatgtattaactgtttaatatttatgtgtgatttttttcaagttcagttcaaatcagctaaagagttaatgttaaatattcacaataaaaaatattttttaaaacctgtaatgcatatttatgattcagttgatgagccaaagcatgaatttttataaggtctctgaaagatagaacttacatagattttataaatattttcaaatttcatgtgttacatagacttcttaattagttgtctatgataactttgatctgctccaattaaacagtcttaagaataaaagtttttttgtaaaacaataatcaatttgttgtttatttttctgttgcaaaaattaacctgtattttggtcctttaattacttgcttgtttttaaaatttattcccacttgagtattaactcatgtttttctgacctgatttagcagggaactgtttgcaagataaattggccaagagaactaagactaacatcagcagatttcctttttcatgtttaaataaagtactcattttccttgaagtgccaacatgatttatccaaatctgaggaagagaagaaactaaaaaaaggattattcaaattttagatttgtagggaaataatgttttcacttatctcatttggattcccaaaatgctagcttaaaccaagccaagcagtggcataagataatagacccaaaatcagtttatattccagcaggataatagatgagccacagctggatgttctccatttactcatccatgaacaaacatgcactgagtacctgctgtctactaggtactcgggacacacagataaataatacacagtatctgtcctcaaagagccctcactttgactggggagaaacatacagatactaaggcaatacagaagtgcaatgttagaaatattcacacgtacgaaagccgaaagtgcatctgtgtaaacaaaacaaaacaaacaaacaaaacaggacccaggaccatgggaggagggcagagtttcccaggagctggttcctgagtttaaatgtgctggtttgaactattgtgtagttaatggtaagttcacatttacaaaatagaacattagacattacagtgttaacacaaagaagggttttgtatgaaatctccctttttccagtaataattttaacttatatgttgagaatcggaagtttttattttgtaatttaccatgatgcctttaaaatatgccgtgcattgttatggttctttaaaagtaaatttagcataactttagtaaatttgatcacctactttagtttggatgaactaaattttgttcaaaattgtactatatacttctgagtaaatataacggatttgttacccatatttactaatatcactgccaaaaccacttttaaactatacctaatcactggaataatctagagttccaaaagatcaaacttgtgacttagaagattttgtatttctgaagtttttcttcttaatatagcctcttatctctgaaacactttaaataaatgtatatcatctaaagaaagttatacttgtccattaagattgggttctggtaaaataaaggtaatatttcttgtcagttgaagagcaattttcctaaagcctgagtgaagaggtgcctccccaccagaaagtatattcactcacaatgtccaatgatctgagattaaatgtcaaatacttactaatgtatctacttgaaatagagatggcaatggaaagtggacactggctaatttttttttttttttttttttttttttttgagacagagcttcgcttttgtgcccaggctggagtgcaatggcacaatctcagctcactgcaacctctgcctcccgagttcaagaggttctcctgcctaggcctcccgagtagctgggattacaggcatgtgtcaccacgcctggctaatttttgtatttttagtagaggtggggtttctccatgttggttaggctggtctcgaactccagacctcaggtgatctgcccaccttggcctcccaaagtgctgagattataggcatgagccaccgtgcccagccgaaactaagactggggataccatcagtgcataattattgtccaaagacagaacatatgggactaatatgtcagtgttttttatatactaaattgaaataaatctggtgggaacaaacctgtttaacccttgtttggcttcttcaatgattttaaattcttagaatggttcaaagtttttcacattgagatccagctccccatctttcacctggaggaagaagctctgtggggggttagaaacagggggatggctgtgcatgctttgcttctgtttaaaaagggaattcagtctccagaagggaggggattgcactggatgcttggagcaggcatcagaacatgtagatggttttggataatcttcatatgaggttatcttcaataactcaaagagttgattgacaaaaaatagttgattagccaggcacagtagttcatcccctgtaatcctagcattttgggaggccgaggtagcaagattgcttgatcccagtagttcaagaccagcctgggcaacaaagtgagaccccatctctatttaaaaaaaaaaaaaaaagaaagaaagaaaagaaatagttgatatttttctaatgagcatgtagtatttttggtacatttaattttcctgttaagtcaggcaaatcacgaaattatactaatgatgtgggagaaattgcattaaaactgggggaaaagagcccaagacttaaaacttacctcatctagatattctgtagttgatcataattactgtacagaatgcagagatctttagaaaattattgtgttgatacagatggggacttcttttaagaattccaaatggtaatgcataaaaatcctaagattggttaacaagttgcaaaattgtgagatttattgagaggctcttatataatggaaatcttccttttattcagatgactaggtgatcaaaaatgtgatatagacaactttttaagaagatacctttgtttttgaaacagggtcatgctctggtccccaggctggagtgcagtggcacaatcatggatccctgcagcctaggaagatacttatttatttcagtattcttcattatagtacaggatagatctgtattatatactgtattatatattttgcttgtttggttaaaggggggtggcatttaattggctcaaaatgcccccttagaaacccgataaaatcttcccagtaggtggctaaaactgcttcacagacttgcccacttgtaactgcagttaccatagtatattagaagtcttgagataaaaataaaagatataactattagctattccataataggcatcactccattgtcaagagtcccagtgtttcaatctgtaaagtaactttgggacgaactggtttactgtgtagtactcagcctggttaccctgcttaagtttaatatacagtattagagttgctgaccttgatttcttttagtggagcattatgatgtcaactctactattttctctattttgttaccctttggtttatatcttggcctgatacttaaagaaagggaaaaaaaagataaagaagaatagcaattcctctaagcgggtctatttctttgagcagataattcttaccagaatatcatactttaagccacacctagagcttatatagaatttttatatttccatagttacctgaaagcatgcttcatccattttcagttctgccctagttgctaacagaggcattgccattggaaagtggccttcaatctctttctagtttagggatattaaaatatacttggaaatgggtcctttcctgtatggatgacattctagatatttaaggactggtaaggtctctgtttaatcttgggcttatccattttaagccctgattaagcacaaattccttgaccatgcccagcagggctgcagctcccaatgcagtcatcgctcagtgctctgaaaggagcaagacatggagctcttcagtcagccggaaatgtctagtccatccagctgtaactaagcagagagaaagaagggtactgaggctggtgcactccacattcccacccacatcctgccacatgttggtgagagtctggggagccccagcctactggcacgccttgttccctctgaatttctggagcttatttatttttaccacctccctctctgctttctgtgtccattccttctgctccttttaggtaactgcagccagagaaaggatgctgataggatttttctgaagaaaggtgtttttgatcaagagagttaaaatcacagaatgaagtttggcttgttatacctttaaattctgtggctcatgaagcatgataaccaagtagtgtgcatgttgttcaagcagtggccctttcctaaagctaagtcatcatttctcaagagatcatgtgactgcataagctcatcattaaaagcttagttttctaggcttcacctgtgatttcaaattcaaacaagcctatgttactgtcatttgctctaaagaccatttttctaaatccctttggatttatattatctctaccaaggcatggccatcttggaaaaatattacatataagcaggatttgggggtaagaaggggcactttgtaagttgtaaggtggatggttactagcctgaccttacttctggtaatccatattaccatccagtgataagtggttatatttttcagtccatttccacctttatgaacatactgatcttggaaaattatctactcatcctcttttccatttctgtttaacagtgattcattagtttgggctgtagagtggatcagctggtgtttacgaaggtatcattgtaccagtgagtcacagaggcatctactgattctcattcactctcagaaaggaggagtatgtagctttcctcctcaggggagtaaagtattacaccactttatagccgttgtttgaatcatataattaagatttgatgtgattattcttagttgacttggggttagacagacaattcttgtatttggttttgccttccgatttaatgacatgcagcctctgagaagtgagcaaattcaatttttctggtgctattatatggcattattaaaagtacagtgccgtgtagggaatatagagttatgttcttggtgaattcataaggtattgccagtacgggtctatctgatttaagccctgctctcccattttgtattttccattctttatctccccttttcttttcggagtctatcttaccaccaaagcagaaattttaggattcattcatttattcagtgagtatttattgaggaattatgtgccaggataagcactgggcatgcagtggtgcgtacgatggacatagcctctgcactttcacagaacttacagtctagtgcagggactagggaaccaaatccagcccaacacctgtctctgtaaatacatggttactggaacacagccatacccattcatttacatattgtctatggctgctcccacactgcagaggcagacttgaataattaccacagggaccctgtggtctgcaaagccaaacatgtttactacttaaccctttgaagaaaaagtttgctgacccctctctcatggatagtgctgaagacatttcataaatgcagtctagaactggaaaagccttgccaacccccttgaggagtgtgtattctccagagggcagtgggctactgctggaatatggtaagcagggaaagaaacatgttgatgtatgaattttagaaaagtccctgtggctgctgtgtaggaagtatgtgtcagggcgagaagcactaggtcatagtagttaagagtgtagatcctgagccagactatttggattgaaattttgactctactacatactgattctaatcttaggtaacttccctgtcagatgtcccatctataaaatagacatggcaatcatagtacctaactcatgggattgaataagttaatgtatgtgaagcacttaggacacagtgtttaccatcatcactattattcctattgtaatcttgttcagaggtgagggtgcctgaattaaggcagtagcagtgaggatgatagaaagaagtggccagatggaggctctacacaggtgatagaattgacaggaatttatgattaattggatgtcagaagggtagataaaagagaataaaaagttgagggtgattgcaggttttggatttcatcagttgagtgaatggtggtttcagtccctgaagtaaggagacagtcagtgaaacaggcttgtgatgtgaggtgaatgataggttcagtttttggtatgttaaatttaggtactagagagatatgaatagaaatgttcaggaagaagttgcctgtaaggttttgagttcagaaaggtgatacgggctggggaaatggatgtagcagtgatcactataaaactggtcactgagcttggaagagaatgaaataacctagaatgaggatggaatgacaaatagactaataacagaaccctgaagaacactaacagtttaagattagacaaagaaccattaagtcaaaaaaaaaaaaaaaaaacaacttttggaggaaaataaacatgaatttttaatccattaaaatttctgtcattgaaatagttgaatttgaaaaatatttaaatttgcaattttggtattagcataggtcaacctaaactatggcgtgtatttcacaatttgatttcatgtactatcatattctatattcttctaatattcaatttcttctctatggaacattaggtaacttagtggatgctatggctatggatgctgacatcatatgagctgttccaactactcttctatatttaataacatttccttacctccctgtttaccaattcacttgagcctgtgaaaggaaaaactgaagtggaggagaatgtctttctcctttttgtgttatacttgtttcagcatcaacaactgggaaccagtttgttacaacattttataatgatatctctatattaatttacttacaacactaacataagtaagtataattttggaaggagccaggagataaattggagaaacgaacactttttccatcatcagaatcaccccttacctctctcttacagtcatgcgtgccttacactttacttagttaattcccaagagaatcttcagttcttcctgaatatgatttccaaaaaaacagccttctactcacttactctgacccttagtatggctcacaggttaggctcaagctaagtctctgaggtgggacaatcagaaggctgatctagaggctttctcaaccctgtaccacacatgcctgaagaaaggcatcacatttatacaatcaggctgtgttgccttttctatttaggggggaacttgtgaaaaactttgaaatgctcccaaaagatgtctgtctaactcaactttccagcttatctcaccctttcctattttacaatcctggaaattacagaaaactgagagtgatgcaaaggactcttgcccattgaaatggaaatagttctggtggaatgcaattgattattgccctatgcagagtgaccaatttaaccagatttgcatctatttgtaaattctttgcaatattcttgatgtttatgtttgtcctttggatttatttttgaaccagttgtaatatcttacaggttccttttttaatgagttagttaaaatttatgtcccatcttcaaaaaaaattatcttgttatatatacacatgtatgtttatacatgcatatcacatctgtagaaaaattcacaagaagttggtagctgtaattacccctgcagaaggaaaggcaggaaagcttgcttttcactacatgcccttttggatgttttgaattttgtgttgtatgcctatgttacctaaacaaatagaaaatttttaaaaatttctttttgaactcttgaaaatcaagacttagcgatcccttgactactaatttcacgtctgaaataactgactttctataaaggtttttgcctctaaataaactactaatagagagcagcctacacatcaacatcatacttagagacttacttttgtattttttaaggcaaactagtaaactttacttttcaaggtagctctaaccctgtagaaagattttggtcgggtggtgctaattctatgactactctgttggggaatcacacagttttagtgtagagggaagtggcagacccatcagcctattttgcatttattctgtatgcaccttgcctcttcaccagctgtgtcctctataatccccttgtctaattataacgagcagccctcccattaagccagtgattctcaggcttagatgtatattaaatcaccaggagtgcttttaaaaatcgaaatgcttagaccaattgaatcacaatgtctgagggtaagacacagacattggcattttttaaagtgatcaaggtgatgccaatgttgagaaacagtgtcttgtgcgaagaatggtactggcttaggaaaaaacttaacaaataatacctcagaagcaaaagcactcaggatatctgactggaagatctgcataggtgatgaagacggcccaaacagaaaagagaggcaccctttactgtgaatgaatatccttgtacaaagaatctgttttgacccatgctgcttctggaatggggcaaactagatatgggggagtggtttaaaagcccgagctgacttagttacagatattagctttttttatacttctgatttcagataaactctcagtgagtaaaaaataccaaatcgggactctgcatatccccgccttgttcctctgccatttggggcactgagccagcctgctgacagtgacatccatctaataccactgccaccatatggttgtgctaccgacaaaaggttatatttatcacacacggtacaactgggaaaaccacatactgtacaaacatgacctattaagcatctgttttaatcaaagattctagaacttctttgctctaacccttaaaaatatgctttattaagaggtctttgatagagaagtagatttgtaaagggagaagtaaaaatgcatcctttcattaattttgaaatagtaaggcgaggagatagcctatttcttggtatttcttctctaccctgaaagatatctcctaatgggaagtcctgattaatggcccgcttgtattccaaactgttttattgttgcctcagcctttttcaaaacctgaaaattggtctcatgagctctactgtggtggtttgccttcatgtactcattgtatatcccctcccttttgtataggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagagtaagcacacatcctcttctttctaaaaatggggcaactgttgttttcataggtttttaggtttagttagattgttagaatgaagaaataattattgatgcctttatttcaaggaaataagaggatctttgaacagcaaaatggtcagaaggaggcagtccctccatttatgccattgtattgaaggtgggctgtataaaattctggggccctctacgtcagtgctattcaaaatatggtccccagactggcactggtcaatgaattttttgttaccagtccacagtgagaaaatgagcttgcaccaggatgtaagtcaactacactattaaatattttgtttagtttaagtgacaactttttaatagcaaaacttccttgatttgttgattttcattctggagcaagtgccttatcttgttgtggaacaatagcaaacagtaacagtgttctgggtgtctcacatcattaactagatttatgtttcctttaatttttttccctcagtactgaaactggaaattgaaacactttactatatgcaaaagtaacactcagatagataaaactgtgacctaagatttccaattcttttcatgtagtatgatttttaaatgaaggattttcagctcttaacttttgatggatagtgattactgaatgaactcaaagcttttctctttcagtttattcaataactggttctactactataggatctacatagctttcattaatgtagttggaaatttaattcactgctactagaaaacactcaaaatgtattcctgatgatgtattgttagcataatcttcatttttaaaaggttaatacagcaggtgctcacactcccatacctgttcacatacacgtatgcatgtacacacacacactcacacctattcaccagcattctttatgaccgctaagtaaaatcctgtgtccaatataatgccatttaatagactttgagcattcctgtacatttactggtaaaagtgagaagagatgagtgaaatgtgcaaagaaggtaggagtggaagtgcagcagtgtgatggtgagtgatacaacctcttatacagagaacagtcagagcatctcccagggctgtgaaggaagaatcttagagtaatttattcccagtagagacttgcctagtcatagatagcattgccagatttagcaaataaaaatacaagatgcccaattaaatttgaatttcagataaatggttaaaaaatttagtatatgttccaaatattgcatgggacatacttaaaaatttttttaaattggatttccctgaaatccaattttaactcggtgttctgtgttttatctggcagtcttagtcaggagataaagatggttgttaaagagttacagctgccatgtgaggaccctttaggacccctaacaggatctcgagtccctcgtctagaacgtgtctcagttatcctcagtgcagcactcagtcagatccctcatctctgttacagaggtgctttgcgaaatgactggtggcatttcatcactgtaatgagggagaagggaagggactttctgctgcaggctgggacttagtataaagttattgaattctcacaaccaaactgtgagagagctcttacctgtgtgtgtgaagtctgaggctcagacagagttgtgacttctttgcatttacctagaagaatggcaaaactgtgagtcgcccctaggtgatttggtgtgaaagcccctttgtctccatcactgcacacctgaggtatatatctctctctctgagtagtgtacctcagtgcagatgttacaatcagagggtgagcttaacagtgtggaaacaagaaattttagcacataaactgtttatttaaaaatatgtcacttaaaacaccaatataaatatagctaacttttcaatataagaaataagaaaattaaatgatgtacaaggcttaaagcagggcacaggatttagagacatcctctgtgccttcctccccttcacccctcacatccagtccatcagcaaggccccttggttctgccaccaaaatgtagcccagatcacttctgaggtccgcttctttcctctcctctacctccacctgaggccatgcaaccatcatctctcctggaatcctgcagaagtctcgttactggtctttccatttctactcttgcctcttactgtcttttttttcagacagaaatcagtgtggtcttttagaaacccaaatctaaaaccattctgtgccttcccattgcacttaaaacccaaactcctaacgtgcagcagcccccacgctgtggcccttacccaccttgcagacctcttcttgctactatacttcttgcccacatagtccagctgtgctggcctgtctcaggtcttctgcatatgctcttccctcctccatgaatgcttgttcctttcttcccatgacgggctggctccttcccatcctttaggcctctcttgcacttctctaaccatgctgtctaatttgctaaggccccactttattctctattacttctctttagccattttcttcatggtatctatcaaattttataattagatattggtttattaagttgtttattggctgcctttctcattagataagttcctaagagcaagaactatgcctatttgtaagcctagtaactgacaagtaggaactcagtagtagtacccagttggtaaatatctgtcgagaatgaatgaacgtgtgaatgaaatcagccagggttcaaaccttgatgccatcactagatgtgagatctttgaccagttacttgtcctctctaaccctcagttacctaaacgttaagacagatctaaccataccaatctctcaggattagcattagaattaaaatgacataattgactacaaaaagtcttttattagcctgttggttagaaacctgagtattattagctgtttttactgctatggtattttcttccttaccttgttgtcaacattcgaatgttttcagttactatttagctttgataggctctgttgctttttggaaaacataaatgtcacacattgccttgtctacatcctcttgcttctactagtaccttccatgatgctaaagccttcatttcctttgaaaatttcagacacactgatttccatgggaacctcgcatctctgagtcctccttgcaccccgcagtttccttcctgtctcctttctttccttcttccatgccttgcatagccagttctgtcccgtgttctttcctctggcacaactggagcagtgcctagaaataggacattgcatgtttttgtgtattatttctgtaaatattgtgtctccagtaaaattaaaaggcccaaatctattttagtaaatgctcctaagcctctctttgaaatcctatactagtgataaaagtcattttttaatatttcaaaatgcccaaatataataaatcccagaaacttttttaaactgaatccaaattattttttaaactggattctttctcccacttaaaaaaaatgagataggcttcattcctttttgaacacttacaattcagtgtagagtataacatacttttctaagtaaaattatttatactttagaatgtggacaatctttggaatttttctctaaaataataaccaaccatgaataaaaatcgcctaagtgttgcatattacctaatatgcatattagcacttgtctgcttttactagcaacatattgaaaacatatcgcacatccatattgtgcacatgaggatgcacccttcctcatcctcatccctcatggggaatgtgcttggagcccctcagaagctggcttgctgtggctggctttttgccgcttcagaacacaggccctaacagccttgttctcctgcctctgtctgtcatagaaatgaggcacctgcatagcttagagaccaggcttgggctgtttgtccagctgtgacatctgacactgtggttagcttgttcgttcttgcggctgttgtgtagtctttgtagatgaatgttctcttccctagaagcaggagagaactgtccagctgctggcatgactcacacttctgtatgtgatagctttgaattacattcactgactgagtaatttattggctgttgattgcgtgttaaaagggtgagtaacagtattttgagtgaactggaggcctgcttcttttttaaagacttgagccaagaatgacttcacctgccttcacacttttttctataaaatacaaatatgattttcttcacagttcaacagatattgagtatctctaatatgtaatgcactgtccctgccttcaaggggctcaccatctaccactagggagaaaggaaagaatgccataatgtaaggcagaatgtaagaaccattagaaaggtattttaataatgtggttcagaggagtgagaggtcaagttacaggggagtcagaaaaggatactttgccaggcatggtggctcatgcctgtaatcccagcactttcagaggctgaggtgggctgatcgcatgagtccaggagttcgagaccagcctgggcaacatggtaaaaccccatctctaccaaaaatacaaaaaaatcagctgggcgtgttggcgcatccctctggtctcttctacttgggaggctgaggtgagaggatcccttgagcctaggaggcagaggttgcagtgagccgagatcacaccactgcactccagcctgagtgatagagtgagagcccatctcaaagaaaagtaaaagatagttttcttttctgagggggatactagggaagaccctgaaggatgagtagggtgccttcaggaagagggcacttgaacatgtagtagaagacatgagcatgtagtgcggtttacttggatctggaggtatgtggagggaaatacagctgggaagatagtagggcattggaagactacatgccattcacagagtctacattgaatctggtatttgggaagacccactgaaggtttataaagagaactttggggatttcaaactagtagaggtgttagagtagattagggggtggaggcctgttagagggttagtggcatttgagtgggaactccagtggaggttatagaaccagaaaaaggagattcagtgtaagagaacaaaagagttagaagcagtaggccttgggaggtgatggagtggaaggggaaatcaaagataaatccaaggctttgaagctcagtaacacaaagaggagtggtgccattaacagaaagaggctggttaggatagaacagtccactctgcccaaagctcgtttacctgaactggtctgctgcccggtttagatgaattcatgcagagccagtcaggataaggagcctgtttatgggaagaagtagaaaattctgtttgtggataggttagattttcttctgataaagtttgggattttatttccttttactgtgaactgctgatgcaaacacttggaaatattcttaccctttttttctgcccaacaaagcagacaatcggaggtattctgattcaaacaaatgaattaaatattttgacttattgaatgaattcatttgcttctaatatttaaccttttctcccacttacacaccttttgcatttctgttttgtagaaaagctatcttagttgcaattacaaagtgagatgatagatgtaaaagtgctttgaaaattctaagagctatgcacatgttagtaagatcgttaatatctttcttaagcttgtctatgggaaatattttttaaaaagatattttacatttacactcatgccttatatgccagataattctcctcttacctgagtccaaaataaatattaattcttatactgtaattttatctaaggtgaattgtgtttgtgaggttttcttattctctatccatattaaaggttctctttgatatctaccaagctatttagaatgtattgctataatttataaaatggttgctatttttaaaacattgatttaattggaatgctatagctttccttttagttttgttttatgtatcttgatccatagatttcagctagagctaaaaccttaaactactcataaaacattaagacaaatatttagaatatatagaaatcatacatacacatacatatatgaatcatgtatatgcagaggtatttgtactttgccctagtttctgtttttggaatatgtggtggttctatgtgaccatccaaactaattgatgacaatttttcacacacaatcccttttttacatagattgcccaaaacatattttatttttcagactacagtttggcaattttaggtctaatgttcagaaaacacatttgaaagtggtttcacatgacccaagatggacatgttgcttactgacctgaaaatttttactcttggaaactagactactttgtgaattcaggggttttccagatttactttaaaataagtccttgtgttctgatgtctacttttcttcttcacacacatataaacacaaaaacatatacacattgcatgttagaattttctcaagttgatttttgtttaaggttctggctaacaacagatgcatttagacaaactgaaattattttaaaaaacaggagttaacttacgttacccccatttctacagcagtttagggaggtaccatatttatttcagtgaggctacaaaaactggaaatcaaggtaacttgtttctctaaacttccattagcagagtagcagcaatcttgaatccctctctccctgaagtgccttcttacccttgataggttctagatggctcccttcccttggtggaaacgtccttctgctgcccagacctcatttggttgatgagagccttcccactctctggttattgtccaagttgctctattgacagaggatttatcttcatttcccctctcttcatccctctagctctgccaccaatgttacaattcacaaagtatgcctgataaaaagttataaactcacgttgcatttattgtattttcacagacctctacccccaactacgaatttagaaaaagtttcctggagactagtttgaaaaatatttacggtggcaccactagatatcccataacaacccaccccagtgacagacaatttcaggaaaaccttgactctttttttctctccgaataagtcttttgcccatgggaaacaccaacacagagattaagggatgttttttgtaccctttcctcctagagcatctcagtgtttgagctaacagtcttttcaaagtatttagtcattgttctctgccaaaaggtgatcagttccttccgaaagacagcctgtgccaatagacccagacatgctagagtgcagtgtgcatggcggaacacacgcccctttccctcagtgggtcagcatggtcacctttggtaatttagctcagactattccagaaccattagatacaggctgtctactacaatatatgtttctttgatgcatattggctcctgtgtgtttggtaaatagggaaattatatcaattcagtgtgtaagtttttgtggttcatagatttcctcttgcatattaatgtttggaagtgatcaggaataaggtttctcacagctaaagagacagccataaaaaattatttatgaagaccttaaggggaaaaaattctcttctgcagaagtgtttttatttagtgaaagaaatggggagtttaccggctttaagactcactcactgtagttgccgctatatttagctgtctgaagaagctgcacgtgcatccaaagaaactgagaaggaaactgattgatgaagaaggccatccttggatcatacttttaattttggtgaaattgctctgttattagaaatgaatgtctccaaagacctacaaaaaggaaaacacaagcctatgggttttaagtttgcaaaggatggactgtcatacgaaatgcaaaaattagttgcaattttaactgtgctgattggttttggtttctttagggctctggtcccaaagttcctaaagtttgtgtggtctggtcattgtccctattttttttttaagtcctattgccctccctctctccctccctccctcccttccttccttcccgtattttttttctgaagtctttctttctttctttgttactttctttgtttctttctttcgcatacccttgcaaaacagagattgctaggactacatatacgaggcagaaatgcctataattgcacctaaaaggtaggcatagccagactgctgggcttagggctatgctatgactgctttgcataatatagccataatataaaaggaagaatgggagatattttctatattttagattaataatttacatgacactgtctagctggtaaaccaagcataaaccaacacttatatagaaggaatatcccctacctctccatttattgtagaagcagagcatctattctgaaaaatagacgactctcaatagacagcaaggattacatatggccacaatggggagaaacttggcccagtttagagccaggactcaattttgccatagtcggctataaaactccagatgacttcactctttacatttacacatgtagatctttacctctggaatatctggtaaaaggacctgcgttggagagaaggcaatctttaaaagtagttgaaccaggctagaggcagttaggggaggcttccttcctctcattctgagtttaaaattgacttcaactccttgatctataggaatcatttgtgacagtttccccatggttaaggcaagtcattggagagagctgtaaagcaagatcataagcaccaatttttttttcttcagaaaggattgtagaagtagtaatatgaataatggttgaataattgttatataacttcttgaatgcacttataaataagttaattatctttgctcattttaagctgaatatgtaaaaggtacacttggtatatcataaatagatttagtctttcatcatttttgcaagatacaagttgaaagtgctaagaaggaaaaagggcttagcaccaaagccaagctaattacatgagttaaaattatataaataatatagtttaattacattcagtaaacttttagtctgtccctgggaaatgacctgtagctttgcttccctcttcactgaatcctaggggagattccactcttcaaaatgtagctattgtataggaggtaaatcacatttttaatagcctggtgacttattttagaatgaaccctgccattttaatcaaatggaaaatattcgtgcattctccagagtagaaaggcccagtgagcgaactaaaaccatgataagggctctagagaaagatttgagaatctaaactccacattcttaagaccctggagattcacaagtgtcactttaaaggaaagtgttgtagtcttcagtagaaggatgtacttcaacttttgtgaggcaggagctccctccagagtccacacgtggtaagctgcaggcctgctggagtgggtccccatccaaggaagatatttaaggctgatttcttctcccagtgagattgagttggggaaggggtattaaaggaggacagagaaactctcttgaaagcttctattgaagtctgtgtaaacacaactacttaagaaagcagccttgggtattcttatttaaatcaaatacaaagaagaatctatctatcttctgggcagacaataatgtaacctagactagagtttggttggttcttgacctcatatcttctgtcattgtggtactagtctctggctccagggtcatatgccagatgttgaggctgatgagtggaagggctggaattaacagtgtgctaagggtgtgcaccagtagacatagagtggcccagaaagggttcagccctagtgtacttatttacacttgtttatatggttttcaggaatacttctcgatcacttcaaatgaggtctaagctgtgtcttccacttccacataattaactctgttgctgtgactgctgcttttcttatctctctgttgcagcagctgatggagatgggggggcctcagtcagtgacagtaaggatcagcagcatcactgtccctgtgttacacctatatgcctagcagtatgctgggtttttaaatgtactatctcctgtgcttataaccatactgagatagtatattttcaatttcactatatttttggatgatgaaagtgaggctcagagaactagaaaacttgcaggtcacgtaactcgaagatggagatcctgggactcaaattctggcatatacacccattgccttgttagggatgctaacagccaagaggttgtgttccagtttgctacaggacattaacttctttttacagggaaagttagaaaaaggtaaaaggcaaaggtttagtgtgtcattattgcagaattttttcttgcctcctaagacagggtttcacaatctcggcacttgacatttgggccagataattctttgttgacagttctttgtcctgtacattgtaggatgtttagcagcatctgtggcatctacccactagatgtcaggaacacacacatccgcttccacctccctagttgtgacaaccagttctccagatgttgccacatgccccctggggggcaaaatcacccctgattaaaaatcactgctgtaaggggttaattgaggtaatgttatgggaggagggtgtgacacaatgaaaataacagagatggatttataggattaaggggaagaattggaacagattgatgaaatgggacaaatagataggaagactttgtcctaagatgaagatagttgttagattagtggagggggttacatgcaggttcacaggctccatcatggcagatctgaatattgttggtggtagtacagtaatcattcatggatgcatttataactctttctctcttctccctcctcccgctttttttttttttaataacaaataccgggagtggagaaaaaagatccaatcctgctatttctctagttctaccttttggccagttggtggccactgagggcgtttcagaatttggtgtatatttgtccaaactttattctgagttatattaaactcattctcctcttgaattatcctccttatttcttatttccattacttggttttgttttttgttttgtttttgagagagagcgtctccctctgtcgcccaggctggaatgcagtggcacgatctcagctcactgcaacctctgcctcctgggttcaagtgattttaccacctcatcctctccagtagctgggatcccaggtgcccgccaccacgcccagctagtttttgtatttttagcagagacggggttttgccttgttggccaggctggtctcgaactcttgacctcaggtgatccacccacctcagcctcccaaagtactgggattacaggcgtgagccaccatgcccggcccatttcttgtatttttaattagaagaattgctaatacctgtggggggaaattatttgaagtaacaagaaaaatatcaatcatgcttattttattaaccttcaaagacaattttacagtatacttatcaggactattataagaaattcacttataaatattgtagttacataccatcgaatgccagaatgaattatacaaaggtaaagtacgtaacaatactatgagtccttgctcagtgtcttcaataggttcaggaagaagatgtacaatgaagctaattttaccataggcaaattgatattgttgactgaaggaaaaaaatttaagcttttaaataattaaagttagttctatttggaagtcttactgaggactatagactgaggcttataacccagaagcaattctgtcaggctgttttaaggcagtattttagtttatggtttacatgtaggtggtgaagatttaatatgtgtaaaattatatctaagtttcagtgtaagagtatatttggtgataggttatagaagtataatcattaattttgtcaaatgttattttatgtataggaaaagacaaggactaggatcattgatcttttaagaaatgtagtgactgaggcaagagttgtggtggggccatgtgttttattttgttttgtctttaaagtattttttacagagctgtatgtcatcactgaatcaagagctttgtgaaattatgttggcaagtagaaatgagcatgcctttttatgtttgttattgtgccttacaacataaacaagagtcaagttcctatggcatgtttctggtcacaaaaatatcaccaaacttctaagtaaggaccaaaatacttctaatattaaatattgaaataaatgtgaagtatgcatacatttaataaatattaataaaaacaagtaagatgatgatttactcaatttttggtgaacccatgagtgatggtactcatagtggtggtgaatttaatcaacgagtaaacgtttacgaagcgaaaattgtcaggagtaccttccaccaccatgcagttcaaaaacaagcaataacaaatgtggggagcttgctgagcgcttctgtcccacatcatttattgtcctgcatctgtataattgtcgtctacattacacatttttatttcacagtaatttgtatttattcatataatttgcaatccactcattccagtttagggtggtgtgcagccagaacaaattctggctgctgaaaacacaagatgggcaccctccctggccaggacgccatcctatcacaggtgtactcagacacacccatactcattcaccctaggctatgtagacacagcatttcacctaatgggcacagcttggggatgtatatccagagaaaacccatgcagacaagggaagggtgtgcaaactctacccagacagtggcatcagtttttttttgtttttttttttctcatcagcattaaaacaaaacaaggttgaatgaggcaatgttattcaaggacctgcactacacttatttaataacttggcttgtcagagcttacagagcaccctttaacgtgcttaaaaaatagatagctacagctgggcatggcagctcacgcctgtaatcccagcactttgggaggccaaggcgggtggatcacctgaggccaggagttcgagaccagcctggccaacatggtgaaacctcatctctactaaaaataaaaaaaaattagccaggtgtggtggcacgcacctgtaatcccagcttctcaggaggctgaggcagcagaattgcttgaacccggaaggtggaggctgcagtgaactgagactgtgccactgtacttcagcctgggggacagagccagactcagtctcaaaaaaaatttaaaaaataaaaaataatagatagctgcaaataattaggcttttatttatgtcagttaactatcaaaatatacaacattgaaattaaaataaaattttaatcgttaattcatttaagaataataatttcattacatattacatattttatgaaaataatttttttaaaattaaaagaaacgagtatcattgtcttagatttttaccaacttctgtaatgtctggcttatagaagataactgaattccaacacctacctctgcattcagtctatgcccctgggttgttttagttgaaatatatgaagaaaatctggcctcactcagatatgtaattgcaaaaggggggagcattttaatagcttttttcaagtaattgtggatactcctttttgatactgtactaaaaactagtggtagttttttaaaaaagtagctgcaatatagaatctgaaagcataaaaaagaacctttagtactgtttctagtctgtcttgcactttaacaggacattttaccattgtatgatgctgtaatatcaggagttggtcatttggaaaatattggtttcccaagtaatgcagatcttttaaatattgacaatttcattatataatgataagaacaatacatttgttaacatcatcatcagtctcattggaaaggccttaactcctgagaaactgtcatatttccaaatttcttagtttcgcctgagagctcaagttttgtcattggcaacaagtgatgtcagttgtttttgttgaagtgacaggctcccttcattcatgttcaaaaaacttccagataaccaatctcagtgaccatagtttgtcctttgtttctttcaagtgaaaatggcattctattaaaaaataaatcataaaaacttattcagcatacagatcagtctcagacgcttttccttgacacacccatcatagttgaatatctaatagaagtctttcatgcatacttcccatttcgtctcacagaatattaaaaaggcatacactcaagggatttaataaaattaataaatcttcatcaaggaagacttactgcttcatcaaggtcattcagtgtaagtggtatgtgttttatatttagggtatatttatgaaggtatattaagtatattagggtatattattatgaagaataacttaaatatgggtaccatttggtgtcattgccttgatttatgctaaggcaccagcagttttacccactttgctttggtaccatcagagtaaatatccacacagtgaaaaagatagtatcttcatatgatcagcaaaataattttgacctcaccaaacttcagaaagggccttggggaccccacaaatctgtggatcatactttgaaaaagccgctgctatagattttagaatgaagaaggtgaataataagtttcctcagaaaaagtttgtcatcagcagtcttccagtttgattattgacaaatacagcattattttataaagtaaaatttaatctcttatacttgatttactggtaatttcagagattctgtgcttagtgatgatttagataattaagatgctcacttactcaaaattgtattgagctctattttaattaactgatacagaagaaaaacttgattttatattgcagaagtgcagtcaacatctgcacaaacatagatggccggatagtatgaaatcctatctctacactaattacttaggattgatggataaaataatagcaaatcggccagctttaatattcctgggactaaaatggttttaaatggtatagggcaaccagcctccaaactggaaggagtaatttattttaccatcatcctattaattaaaattaaaggaactcatgggaacaaaacccaagggttcaaggttcatcaatttattagttgggtattttattataatatcagtattttgtaatgattgcttttggaatgccaagaattcattgaacagggttcccaaaagttgtccatattttttaaagtctagagatagtgctaagataaatataaacacatcataaaataagatcaatggtatttacatgatgaatacctgtggtcagacattagtctgattacctaggttctaaactgctagctcattggtttggaacatctgcaaagctattccacgcaaagccttccccctttagcaagttacttttatcaataagtagtgatatacatagacaaaataattgttttaaagttagtcttaggaccaaattttcagtaggaaaataatataccaacctgagggcatatttcgatttttccaccccctccacccttcccttttcaaaagaaaaatatctgctatatgatacctgagtaagcagtaacttactgtttgtattctaatgattgtaaaacgttaagcagatatataatggaatcagaagaattcacccaaagccagagtaactaagatatgagtggttatgataccaggcaaaatgttataagacaaagccaaccttgcaagatgataaattgtcttatttttcccatcagtgtccattataaggtataatgtgtgagtctacacactgtggtgttgattcttgtatctctgtcccaatacggtgtgagttctctgagcacacagtagggttagatgggtattgctcttccgtattatcctctgagtctcaattttcttatctgaaaaagagggagtcgtcaatttttctaacttgttttaaccacaagaagccccagaatcctttttcaagtgacttcctaggcaactctatgcttttgttcttggcaccttctttaaatccgtgggctcctccaacaagtttggaaacctgagacctagatgttttcccaggtctctctcattttaaaattaagtttttctgtgtttctacattctcccctgggtgttccacaattgtttctctagataaaaaagctgaatagaaccagccagcaagcagctggtgtgcagctgttatcactcgagcctgaactttgtggcatgctttcttttgtggtattgcctcttcctgcatcctggaggggggagtggcttcacagcccttgggccactgccaggtgcgacagctctttttggaaaataatgatagatgtggcatctatttacttggctacctagtattggtgcagaagcaaatgctgctttgatcccagcactttagcaacttgcactgtttggcaaaacttgcgcttcatgtacaagccactcaacactgtgcccatcctggcaaggagagcatcagacgcagccaggataccaggcttgcccttcttcggtttccccaggagcaggcaggggaccagatggattagctggaggacagtcagccattttatattgccaagctcaaccatgctagcatttccaggatataatcctgttatgagaatgtcttcctctattagcctttgtttgtgccagctccaggggtggaggaaacccattttgcctgacatactaagaagtgacctttccagagccagctactgtttggtgaatagttgtcatggtctttccccatatctctgtatatacattcatgacttttagaacatagaaaacttattttttgttctaaaagcttatcatcccgtatatttccttatcctttacccttaccagccttctctacatgacctcaggtttgtgacatgtttagctcaccacctagcacatggtaagcagcaagtacatgctagctgttttactagcagtgatggtggcgtaagcatctctctctctctctctctctctctctctctctgtctctgtctctccacccccaagaccccctcattccccccaatctccctccctcccccaccccccaccctgtctctctcccttcttccttctctgaagcaatatgggattgtcttgaatttcttccacatgtcttttcagagtttttacctttttcatttcttttttctgagtctagcgctttgctttcatctcagtcttcaaatggcccagataaactgcttatcagaatggatgggagcccagtgcataagattgcactttgggagtcacatggtagcttttaaagggaatggcttggacgcttcaagaaccttgctcataatatattaaatgtgtcatagaattttagaactggccaggctcaatggctcatgcctgtaatcccagcaccttggaaggatgaagcaaatggatcacttgaggccaggatttcgagaccagcctggccaacatggcgaaaccctgtctctactacaaatacaaaaaaattagctgggcctagtggcgtgcggccatgatcccagctacttaggaggctgaggcacaagaattgtttgaacccgagaggcggacgttgcagtgagctgagatagcaccactgtactccagcctgggcaacaaagcaagactctgtctcaaaaaggaaaaagaaaaagaaaagaaaagaattttagaactgaagggggccagaggggttccttggtactgtgagagatccctcactttgtggataaggaatcccaagtataaacagtatgtgatcatccaggattaaattaagtggctgagaagaatgaatccaggtcttctaggaccgacctttcactataccagacaaaagagcacgaaagtgtgttgatcagagcagtagttttaattgtagtatttttgatacatttgtgaaacattttatagtaataaaaatttttacttaggagcaaaagaagtatgttatcaatcccaaggtaactctttttaaatgtggacatataaaattccaattatatgtagaagggcctctgcttaaatctaagttgtaagaagttatactattaataagagaacagatataaaaataataaaatcctgccattttcggcaacatggatgagcatgggggacattatgttaaaaataagccaggcaccgaaagacaagtattgcatgttctcactcacgtggaagctaaaaaatttgatctcatggaggtagagagtataatgacggctacctgaggctgggaagggtgtgtgtgtgtgtgtgtgtgtgtgtgtgtgtgtgtgtgtgtgtgtgtgtgtgtgtgtggagggctgggatgtgggataaagaggggttggctaatggctataaacatacagttagctggaaggaataagttctaatggtcaataggacagcaggtgaccatagttaacaacaatgtattgtgtatttcaaaagggctagaaaagaatatttgggatgttcccaacacaaagaaatgataaatgtttgaggtggtgcatatcctaaataccctgctttgatcattacccattatatgcatgtatccatatatcacatgtatcccataaataggtactattatcatatattaatttttaaaagccaccttagtatggcctagaagtagaggatcagtgttgagggtatgggcaaaatttaccattgtaccatgcctgtcacttagatcaccctccagcctggcccctgaaacgcgtacctgaatgctagggagatacactgaaagagcattccattaaaatgcctgtcaaactgaaggatggcaaatttctgtacttgagggtttgtggacacccataggcagattaccagccagtggcttctgcagcgccaggaaaccatgcctgggcacagaccagcaaatgtcatcagcaatggccattccttagaataggcacagcagggggaccagcttcacaggaccaggggcccctttgcagcagagtcttcacctcagcaagcagagctcacagaaaatgaggggtgctgcatggtatccgagagtgccaagttcataaatacacatgaggttcactttgggaatcccatacagagctgaaagagtgatgagcatgatattgagcatttagggagctttggtttcctcttctagcaattgtggataataatacttggcttgtaaagttattgtgggtaacaaatgtgctaaaggacataaaaggcatatcacacatgagctccaccggttggaggtcacagttgttggaggccaccttcatcccttgtgtggcatagagaagcttcagaagctcttttttctgtataggcctctcatcatgccaggtgtgtggtattcagccttatctttaaaatatggtaccctcttcattgtatttcatcctgccgtcttactacaaaagaggaggagtcctaaaggaagttagtaaatacaaagaagttcttaaggtcaacctaagataaagaaatgcttgcttgtaagtgctgggtgattgaatctataatttgcgtcaagagaagtgaagaaaaatgttagggtggtgcaaaagtgatcgtggtttttgcaattttttaatgacaaaaaccacaattacttttgcaccaacctaaccttgttttaggcatgtatctatttaaagacactttattttacctataacgttgatgggtttacattgaactcagggccaatagcactgtaactcgcacccaaacaaagcttgtctcacgtggattttctgcacaggacacagcacagcatctttgtgcttaggataccaggtagcacactgacattattctcgggaggctgttttaaacagcaaaattaccaactaaaagcacaaaaatgagaaaatctgtggcaccaaacaaactgcaaataggacacttgttttctctctcgtttttttttttttttttttttttttttgagatggagtctcgctctgtagcccaggcgtggcgccatcttggctcacagcaagctctgcctcccaggttcacgccattctcctgcctcagcctcccgagtagctgggactacaggcgtccaccaccacgcccagctaatttttttttttttttgtatttttagtagagatggggtttcaccgtgttagccaggatggtctcaatctcctgacctcttgatccgcccttcttggcctcccaaagtgctgggattacaggcgtgagccaccgcacccggacacttgtttactctatgagcagaaacaagaaacagaacatcctcgtgtgcatgcccatcaggcatctccaattgcaatccacatttgtggacgtagaatccacaaataataaggagccactgaatttttgtatatttagtatggggctcaggttaatcacagaaatatttactatatagttagtgggcaaaatgcccagtaccccattataataaacccaaatctcagtaacagtgaagatgtttctcagaggggcatggctcctctgatgtttgtcagataagcatgtcttattataggggcactcagacaacagaggcacagaacaaaacaaaatattttttgtctgttaatttatttcaaaaatgaaatctgataatggcttttagaaatgtgaagaccaaaaagcatcaaattttgtttttccatttaaggaatagaaataaagtggccgagttattattatatgttccgcccataattcatctttccttgctccttcccacccctccccactttatcttccacctccttttatagatacctaactgctaaaatgggcttgggaaggcagctggaatcatgccaaggtgtacccaacagaagctgctgcagttagtgacatgagctatggaacacaggaggtcttttgcactgattggaatatttattagatttagtgctgaaatagtctctgctgataagcagacctaatctgaatttcaaaggtccttatgaccacgtaaatgtgatagtatcatatcctcaggccccaagtgcatcacctttcctaaatggttggatgctgtattgaatctatttaatatcctggtaactagctttgacttttttcaggaatacttaataattttagatttaatcttccctcctcctcctcctcctcaacagaagtaatttaaattctttccaagtagtcattgcacctgtttcttacttcaatcttggtctcaaagaaatatacaacaaactccgatagaccacggccataaagtccaattttataatcatgcaggaaaaggaatgcttcttgaggatcaaaagttgcagtcatgatgctaggatgtttcatatccagtaaaactagagacaccccacctcatcagctgattgtgggagaagtcgtttacaaaagtcctgtgaagaaagaactagatgatataaatgtatgcatatttctagaacctgaaaaatataaaaagataatcaagtgtacttggacccatagccactggttttaaccattctgcagaagtatagcgcaattattattggcaatatgtgaagatatggatgatttcatggggaaatctttgaaattaaagtgggataatttggaggtacaggggaaatgtttttccctttaaactgtggcaataacccttgtaattgcatgtgctctccagaataaagatatagcagattgacatcagcttcagaaaatgagacattaggtacctgagggattcagtcaaattgctcctatgaaatcttgagttttgaagattgaaaaaaaaatgcttgtttttgtgacaagtgttttggggaatattttaggggataattgatgttctgcattccaataccttaggtaatgaggaagctgtggaaacagcctcctttcttttatgaaggctttcgtattcaagatcaccatagaggtcagtgctgtgaagctaatcttggacgcctatctcaattgcttcagagtatttaggatttctaaggtttttgatggatttttttcatcaaaagatataatttttcctccacatgaaatgctttaaagtggtgataattaaacatatttactcagtaatatttggaacattatactggaattcagaagctctggctttcctctttggatttataaaccaccaaaagttggcaactggcccttgtaaaagatttcttccagcagagctcttgtatctttgtttgtgttttcctttcccgcttaagcacatttatctttgcttttagctgctgcagccctctgagaaacagcagtcttcttggcagctgcattctgtgcaggctcctgctctatcagtatgacagctatctagaaggactatatattagatggaataaccagctgatatcagaagggaaaaaactggcagcaacgaagcacaaagttcccctcagtataatttgcaaatctttcaattaacctattgaatcaaaatgagaatgggtataaatagtaatgatttttaaaatatgcccttgctttttagaatagatgcattttcagcaaagccatctgcaaagtgaatacgaaaatttggtctaattctgttagtaagttgacattgttgttctggggaaagctttaatgtattattttttatgagaataaaggtatcaggctagattttttgcccaggggtttgctgattatgaagctgccagagtaatgttccattcacttgtagttgtcttaagtagcaactttaaatattttgaaaaaaggaaagaagtatttatgtttagtagaatatttaaaggaagaaagtaaaaacaatcacctgtaatcctaccagccaagtaatacatatatttatgttaaactgtttgtttgtttgtttatttatttatttatttattgagacagagtcttgctctgttgcccaggctggagtgcagtggtgggatctcagctcactgaaacttcctctgcctcctgggttcaagtgattctcctgcctcagactcccgagtaggtgggatttcaggtgtgcaccatcaggcgtggctaatttttgtatttttcgtatagatggggtttcaccacattggccaggctagtctcgaactcctaacctcaggtgatccacccacctcaacctcccaaaatgctaggattatagatgtgagccactgtgcctggccccaagtagtatattttaaaaatatgaggtcattttaaaagatgaggttagatgttatatattatttctaaaattttattaaaattgtttttacacatttttatgtatctttaaatattttttgtgcaacaccattttgctagctatatgatctgctgcatggatgaccacaatttatttcatccatcctttattttgggacatttggattattttcaggttttcactattgtaaacaatgctgtgaggaacccgcttatggctcagtctttgtgcccatcattgattatttcaagaggacaaattcctagtggaatcactaaatcaaaggattaataactggttccttttacttggtagtgttttgtcaactctggagtctctcctctgctctccatccctgtccctcactgcttccacttcatacagaatatatttgttttgcccttttccatttttctctttttttgtctcctttggtaatggtctccccctgtatatggactatctgtagaccattagaaattgagggactctcaagagagaatgcaacaaactgatactatttcaagatgacagttgaccatagcttacatgcagtgttcacatgagttaagtcattgggttccctgccagattttaagtgaactaaaatgttttctaaaattttggtttgagattttctggcatctgcctctttcagagtgagaattaacataccatctcagttgttataattccatcccatctttgagccataaactatttgataactaacttcaactcactcttcgtgactcactcgcctcagaaagatttgattttctggaaaattacaatgaagcagagatgtaaaaagataagtaaagataactcaattgattccggaaatgaggtagactaccgcaataattttttgaaatagtattaccaaattttctcctttacaacgtttttaaacatctcatatgtatcaattatatgctaatgaactacttgtttcctaatatctttaacaagataaattactaagtgtagccaacatatattcttactaaccccagaaaatgtctgttctgtgagttaataaatgttaactgttgtatattacatactcttttccatatttgttttacagtggagagggtcttcaaaaaacgatctagtacatctcttcattttgctatagggccattactatcaatgtttaagacttctgtaagtaaatattacaacctgtcttgcaaccaatcctgtaatatctaacaattctcttttgagaaattatttactaactccagcctaaagttatcatgctgctactgtaagactgtacctcttcagtcattaacagtgttgaaatttgcttttggaaatgtaagtcctccatatggttgatgtcatttcctcattgtaattagagtacatcgagaaggcatataatcactcactgagtgatgaaacatggattgggagagatgactcaataaacattttaaggaatgtttgtaaagtgtgattttcaaatctgtgttgaacttaaattcccaacttgttctctgcacaactgttttttactgacttgcaccttggtacaatgccattggtctccattgaagtctttatggaaaacagcacagtgaaactctttactgtgtttaccataaggaggcccctgttgttgttgtttaaaaacaacaacaaaaaatcccatccgatcttcacgccatgaatattgtacttcttctgaacaactggtttgttaaacacagacctcaccaggttttcttgctagaaaattcaagccaatattgtgatttacccataagaagtatttggtatacccaacccaccatgctactcacttggggtggtgcgttcatagtgtgctcattgtcagtcgtaccccagaactgtgcacacaggagcccttgaccctctggtatatacttctaaaacctcattcttgattcctccttctttttcctctcattctttctttatccatctttttccctccttctatttttaacttttgtaatactgttttattctgtgtgtctttgtaagctgctcaaagtccttgtggaataaggtgtagcataagttaataactaagtcaaaaatgcagacctttatttgctcagactgttaagttatctatacatccatgcatggtgcccaatgttgatccttactcctgttgtttcagctcaaatatattggtgtttgataagctggtacttctgtaacacagaatatggcatgtaagctcatatttgaaatgagagtccaatatagctataaacatatggcttacactgtgaaatgttctttttttcctttcccagggagttttgaagaaatatacaagaacatatgtccagtcctaggaatccctgccagattttttttctctaaattgtggtttgagatttcaaatcattaactggatacatctgtctgagtatgttttccttttcaaaaaaagaaaatttgaaaatagctacccaaaagacatagttcagtattcttaattttccataacatagttagtatcctcaacctttaaaattaaactgacattctctgagctgtgtgcagtcattttgttggtggccatgtatttcctgggtattgggtgaaaataaggaatttattttcctgtatgttgtttaagcatatatttgtgtgtaattcttagtaaacttgtaggtttaaggaaagagccttcaaattagagtcaaaggattcatttttaaatcttgctgctgtcactaactgtgtgactttaagcaaatcatataacctaacagagcctcagtttctttatatataaaatgaataataataataatgcctgccctttctatttcacagggttactgtgaaactcacatgagataacatgtattaaagtgctttgaaactaatagcagagctattagaactgcattgcctcagtctgggataaaaggagatcacaataactaatagcaaaatcaccatttatttggcttaaatactatctactctgctagaattttaactccctcaaattcacaactagttctgggagtcagccggggatgttgaacatatgcttgggaatggatcctgttggattcctcatggatgctcatgtgccttctctgtggctcactgctgtcgtctcctctgctgctcttgcagccagtgcttagtgactccacggtcataggacctgacgcctctaatgtcctcaccaaaaggaaatacagtcatccccatgcagccactcttaacaactgtcagctgtgaagttctcacctacatcttctctcatggtatctcaacatggggagcataactttctcatttttgggggctcattaggacactaagtgaggaggagcatcaggggatggctgagactgaggtgttctctaaaactgtattcgaacgtttctgtcccagagtttatacacattatttaaggttatagtagagactgcaagctgaatggtccaatgacgatgtgacctttaagaagcctctggcttccttcgtgaattctaaccgtaccgttactgtgtttgaggatcactggcagccgagctctgagtggggaactgagataagaaaggtgttgtcatgataacacctggacagctgcatcccacagactatgggagtgccaggaaactggctacctcacagcagagtagagaaaatggaaataaacacaaatataagcttttcagtgagctgtgggtcagagaaggccacaagtggtctggcagatcatggtgcagctctttgtttcatgagctacgtgcagcagtagtttttatgagctctttttgtagctttccagccctaggattcagccatggtaaggtggaaagtttctggtactagccctgctgttctgctaacaatggtccactttcctccaaacccattgattatttagacatgaaataaatctatgcatctcaactctctgcctcagaaaatgaaatctgtcccaggaaaagttcagatgcagtaacctgctaggaactagggatgcttgtcttaaaaccctacacacatggcaaacactgttttatttagattgagctgattgggaggggtggacctgatagggatatgggcatgatgagctaaagccaccaactggcgctaccttcaaaaatgggtcctaccttccaactatggcaccatacagtacactccaaagcaaggattgtagttaacagccatactttcttaattatctagtttcatcctgaaaggcagacccatccattaattccatgagcattgattttgactttcagccttaaatagagcaacaagtaaacattttttattccccttttcattaatatttaattcattaatgaggacagtgggtaatgttctgtgatatagtactcgtgtgacaaaggagtagtcccaggaaaatttttggaatcaaatcaacaagtatgtattgagttttgacataatacatgaaaatgctgttttggctaagagcagaacttctgatgattagttttgctgacattttaatcttggagatgataaggtagaattataggcttaattttgaccttcacagggattgattgataataacattggaaaaaggtaactaggttatcttagagtctctattagccaaggaaaagaagagaaagtcttcaaggaattgaggcattgtttgagaaaatgattaaataaaaaactataaccacagttttattttgtctagttaaaataaagaatatatagtattatcaagaaaagaatagtctacatgggggttagaataagggaacctaagaaaagatgtgattattgtaccactagctatccatcagagagggagcttgagtcagtcagtataaatttagtctgttcagcacaccctattgtggaggaggaagcagggagcttcaaaactgtaaggcatcagccattaaaacagattctgtgtttgccaagcaaccttctcattgtgaccagagtttgcaggcagagtttccagtgatgactaggttgcatgaaaattttttttttctcatttcaaacagtattttatgtatcagcttcttgtttggtgagcatgtgtaattctcttaagtttaattaattttgcatatttataacaatttttaggaccttccaagtagtaccatctctgtctctagcttaccttcctgtaacttcaacaatgaccatagaggaagatctccaataatctcaaatttaaagagacgatagatagattgattgatagattgattgattaaaacttagtgaaaagctctcagtttaactcttagttcattaatatataataaactaaaatttacaaaaatatcaagtgtagcgtttagacatggattatttgcccataaacaaatctgtttaactagtttaaccttaaacaaaaaaatgtggagcggggtggtgcgagctactagttgaaaggatatatgagtatctcatagaacccaaggtcaggaagtacacatggtggctgtgggagactcggaagtacaaactgaaaagttgagaactaaagtcacatgctctgtctttctcagagttcatgaattctcatctctacttctttctctctgcttctgcatgaaaatagctgtccagtccttgcctgacaatgcaagagcctagtagaaaccaacaagagttccagaagctcagagtttgcagagaaggactctgattggcacttctcaaacaggtgtgcactctgagtccattttgatggcctagggatgacgtcacatggttgctttttcttgggaactgctgtttaaggagattcttagagaaggggacctcagtagggccaagtgatggaacagctttcagaaaaacaggagacattctagatatgtattccaagtgttgtctgcaacgattaaaaaattgctttaaattctgttcagagtaaaataatgaaaaagcaaagagtaggcagattattagggcaaattatatgattttaacgtatgagaagaaagacagatgtgcaatacttttttgtttccttcttagttatctgcaggagtgatttccatattgaaagtattataactgacatcttaagagtgcactagatttgttaaagcctttaaagcctcttacagcaccagctattgaggaacttgccagatgagtttgagaggaagtactgtcagtaatcctcaggtactggagagaagaggagaaattttaggaaactggaggtgggaaaatactaccttatatttttcaaaggggagagagaaaacttgttcttggaaacttgtcactgatacacagtatttaagggagatcatttaaacatatttaaaaagtagccatcactaggtaccagcatggggctatgaaaaagagtcagaccaaagtcacagctacacctaaaagaagacatgtgtttaccttagtagaccaggagactgtgtgatagatacctcctgcagtgtgagttagcaagatatttgagtaaagtgttcagatccccgtggagaagagaaataaatatagtttgaatgatagtgcaattaggtgaaattgataaatggagtgatatcaacctctcagggaaaacacatagctttaaaacagtatttgacctcatattcctccatataaacagtagataaagtggaatcatattagtccaattttcaacatagaaaactgggagggatggttatacacaacaaatgacaaaaaccaaagagggcagaacctgctggaacatgcacctaaaccaacaatataaaatgcaataaatgtaaacatggtattttatactaagttcaactgctgaaatataaaatgggaaacattggacttaacagtaatttggggagaaaaattttagggaattgtgagatagcaatatgatatagttgcaaaaatacagtgccaatataattttagattatacttttaaaggaattatatccagactaagagttgtagcgttgatctcatatattgtccagtccacatctgaattattgtagcagtcctttttgggaaagatgttgacaaaatggggcatttccagagagggataatgaggaattttaatctataaatttctttcgaagcttagattttttattttgctatgtgtaatgcactgtatggaataaaatctaccatactgtgttcccaaggagcatactttgtgtcattccaaccagtgtccatagaaactgaacacttgggtaaaattcactcccctcagtctattgattctgataactgggtttaacagtgacgtattaggccattcttgcattgctgtaaaggaataacagagaccgggtaatttatgaagaaaagaggtttaattggctcatggttctgcaggctgtacaagcatggcactgacatatgcctggctttgggggaggcctcaggaagcttacaatcatggcagaaggcaaagggggagcaggtctcacatggtgagactgagagcaagagagagtggagggtaagctacacatttttaaacaaccaaatctcaccagaactcactgttgtgaggagagcaccaagaggatggttctaaacatgagaaatccgcccccacgatcaaatcacctcccaccaggccccacctccaacactggggactacattttaacatgagatttgtggggggcaaacatccaaactatatcaagtgataaactgtcttttcactgaaaatgtatattgatttctgaatgctaaattaaactttgtattctacattagtaacatattcaagtgtcagcactgtttcttataaattgtaagcatttttccacttccttttatgatgaaaatgagcaaaagaggttttagatgaaagcaggaaaggtcctcaatttattataaaataaaaatggaggccgggcatggtggctcacgactgtaatcccagcactttgggaggctgaggcagatggatcacctgaggtcaggagttcgagaccagcctgaccaacatagccaaaccttgtctctactaaaaatacaaaaaagttagccaggtgtggtggcgcgtacctgtagtcccagctcttcggggggctgaggcacaagaatcacttgaacccgggtggcagaggttgcagtgaggcaagaccatgccactgcactccagctgggtgatagagcgagactctgtctcaataaaaaggaaaaaaaaaaggatagttaaaaaaaatcagtgtttctcaaattgaggatttgtttcctatgcctaaagaatcttcctggttatatttacttcagaattaaggggagagaatcaaaaatgactctttgtcttgagactcctagtgaatggtctaaaagtaagaaacaacctttaagaggagcgagagatgagtaacttccacacaccaaatacacaaaagcatgcacacacacattattgtagattaatgatagtgtatattgagtgcagggactcgcagcctcaaaatgttacgtttttcatagtctgctgaattagatattatttattgatgaagtctaaatataacaaggttttatattaaactacagatgttaaaaacatagctgatacagagaaaatgcaagtgagacatttcatttttatttttgaaatctattttttaagttattggaaaatcactatggaaattcattattctcatattttctgctaatgccaagcacctgacccagatagctaccctgaaaatattctgtaaaattactctaagaataactctaatcattgcaagcctgtaatctgaatgtgagtatatgtgatcagagcagttctacaatgtagctgaaccagtactgtccttggtgttagaggattttaaagctttcttgggaaatgagataccaaagaggagaaattagtcaaaaatatatatcagggcccatccatttaaatgttgtccttcttattagaacttattacaaattctacaccagtaaagtgagaggaatgatgcagaatagggggttttacctcaatacaatgggcatttctttcttactaaatcttaatagcaaggctttgtgtattataaatactacttctgtgtgctctacccagtggcttcatctcacagtgacaaaccagaaaagagctaaactttaagatcctgccttcaggttgacggtggcaaatgaaagcttgtaattgaaggtagctcaatttgtgttgggctgaagctttcatttgggataagtgtccaatccagtcggcccaaaattcagactccctctctgggctgtttctgtgctccagagggtctcttttcctctcttccttttctctctagcatcctggtgacaggaggattgtgcacccttgaggaacatgttttagatggttctggcctgcttacctctgtctctgctgcctcctcctggttctgggtaggtgtgcctgtcttcccgggtatactggcaccctttcatctgctgctgaaggaacccctgctgcagtaacttctattcagttctcttgctgcctttgggaccaacggtcctttcctcaccagacccactatggggacttatctccattttggccctcactggtactgtggatcctctgaagcccgcttgtctacaagagcctgtcgtgtcttaagccttccatcccatagagttgccacatgtcatcctattccttattactgtgacccctggcaggccactggctctcaactcttagctaccatccatgttccccactggaagcatgtggaaacgtctgggctccctggctgcaccctacagccaagggagactgcacagcagatgtggaaagggaagttgtctctaggtctcctgcccaagtacacttcagcatggtttctctttcacatggcaaccaccttctattggatagtctcctccaaagctgggaaatggaggctgcgcacaaatccgttccttcatctgcttttgttaccttctatccccttgttccctccagatttcctacctctccctagtagaagagcttctacttcccttttctgtggaagaggaacatgtcctcctccacagaatgtggagccatgtggacttaacttgttctgttgcagttttgccagtgcaccttaaagtagcggtttctcgttgtctgaacaagtacccggggttctttgtcctgcatccaaaaaaattaaggagcatggacacaagggtgggggtggagtgaaagtttaataagcgaaagaaagcacttcgcagcggagaggggagtccgagtggattgccgagttacagctgactccagaagcttttataagaaactcttctcatctctgtagcagtttgagtaacttctcctatcagtaaagctgtctgtgcaactccccttatcttatgcagctgtgggtatgtctctaggcaagcacaaagcgccacttctcttttctgtataactgtgggtttgttttaggtaagcccccgtcttccctgtgcaagtttctgtggagcccaccatgtatatgcctcaaaaggggaggaaactttttcctgggagcttgctaattatacgaagaacaaacggcttcttttctggacgctgtctgcttctctgtgtgcaggtgcagcctgagtttttgtcccagattgttttgtttttgcccattgctgtgacttttcaggcagaccgcttctacactgtaagtttgccccaactgattttttcttttccctcaccctcattccccacttcagaagtgggaactctaactgctgttagggagattgggcattgatctttctggctatttcttgctggagaggagcattgtgtgaggaacagcagctaggattcctcccgaggctggtttaagggtcctcagaaaaaaggtgcgtttaatgtgtggttccatttactttaccatttggagcttgatggcctctagatgaaaaaaacaatttgggttattagacaacatgtattaaaatgagacaaggaaggaggtaaggatagcttaaaaatcatgaggctgctgacatgccctgataactggtggctatagttaacgtctgttaagattgggtgtatggggcttggctttggttagcttccttggtttgaccttccccaaaaaggaaacctccaggttatgggggcactttatttactcttattacctggcagaatttgtaggataattgcccagaactagaatattgttccagattttgacattacccatccctttctgtctctctgagctgcagccagagatggctggttggtttacaggaataagcagggttagtctaaaatgtaggcaagaacttaaaaatcactaatgagactagaaattaatgaccactgtatgataagttttgaaacataatttccctctctccagtcctcctttttgttaaaaacaaatcatgataggactgagttgtttgcaaaatagactttagttttaaacttggtctgattatttacataagtgcagcaagaatccttatttttacataggccttttagattggctttgatggaactttgttccacaaggaatcttagataggactttctaaagccgatctagacgtggtcatgcctctaatcccagcactttgggagcccaagacaggcagatcacctgaggtcaggagttcaagaccagccagaccaacatggcaaaaccccatctctatggaaaatacaagaattagctgggcgtggtggcaggcacccataatcccggctacttgggaggctgaagcaggagaatcccttgagcctgggaggtggaggttgtgagccaagatcatgccactgcactcggcctgggcgacagagcgaaactctgtctgaaaaaaaaaaaaaaaaaagaaagtgacattctttactcaccacaggttaggaaccctgtacaggggctgtgtagacaaggtatgaggccggttttccaggaggcttttactggctctgcaagtcgaacttgactctttaaagggaaacacaccctttcagtcaaagccttggtaaaacaacgagtttttccaattgtgttttgttgcaaaataaagtagattcttattgcgctgatgcaaacaactatattgttataagtcaagaatacttacaaccagtttctgaattctagagaaaccaggcagagagaaacaaacatgttccaaattttgttcacaggagtataccttacttagttgttaaaagctctagctaatttgaaagaaagtttccttgactctgaaaaacaaaacaagaattagcagtgttcaaagcaaaaatcaaaaagattcgtttagttttctattaggttagtccattccattaactcttgttctgcttaatatttgtaaacatttcagcttttcatgagtcctttacatttttctattatcagaaacctgcattcaagagtacctattaaagttccacagtgattataaaccattttttgaagaagattaaaataagacaacaattgtctgtaaatgacaaaatgtccagggtggttacagtcaagaacatgattgacaaatttggttatttctgtggcatacaataacccaacataacaaccttaattgtgattgatagcaaatattcagacattagaaccttagacatcccatacaattttggacatatgttaatatttttccctaaaacataacctgaagaatattagacctcattttggcaatcccatgtacctaaacatgttaaataatcctgtttacctctcttcagcatgctccagggaccctttgtagcacccaaaagcaaggggccaggaaagacaaccttgagactgaagtttaattttgggaagcctgtgaaatatgttagaggcttaaaacactggatattatgaaataaaattttaccataagtcatttgttttgccaaaacaatgactcaaaaatttgaaaaaaaaaacaacaacaaaaaaaaccttttcattagcccttattactacatgaatagagagccaaatttacccttgcattagtctactattaatgttaaccccagtttttaatgaagccttatagacaatcctattcaatcttaaccagtttgaccatgaggtgagatttttacatacatttttttgtatggttattttataaccctttacaagttttgctgaagagtaggtcagcatcgtaagaaaaccttgttgtgcttttatttcaaagtttaatttacagaaaaaaatatataatacccttttgaatttagtcaatatgttcacacacatagtttcctttgcaagattaatatttacagtcttttcacaatttgcttaaaccttctgctttattttatctaatttaagacaatcctttatctctaggcaaaatggacatttccatgccttcttataatcttttaactaaaaacacattttgctgtttttacacaccttgcatgcaaatccatgttcagtagtctcaattacatgtcataatggtaactcttagcgatttttaactttaatgtaaagcctggtaagttgttttaattatgtgctagatgcagataaagtctgattcctttcagcgtagttaggagcatggtcacttctatttgttcccagaccatactaattgtgaagcaggcaagttgacagtttttaaaaggccaaagaagcagtttgcaaccttaaaacatttagcaaagctagtatctgacctgcataataaattagaccacatttttacaccttgaagacgtttgtattttaccaataattcttgtctgtttttattttaaatattaaagtcatatgaactgaaaggtaccacagcttttacttttactgcaaaatattttatttcagtgcttattattcttaggccaattaattggcctttttatagacttcacatatatatcacatgtatgactacacagacagacagaagaagatccagcagctcagggtggagcccttttacgaacaggggtatgaatatagttttcagggcttaataaacaagcacagccagaagacaaagacagatgttgagaggggcttatccacctctaattccaggggttccatgaggaaaacagggatttctccaaaatgggatttgtggcaccttaatctatttcccagggagtcccaggccaccagaagtcattctagggtctttcacgtatgcatcaagaatgataagacacagtggaaaaaagtaattcagttgactgaaaaaaaacaacaacaacaaaaaaccttttccagaaaaacaagatctatgaagagaaaaacataaaggccttttacatatacccatagctcggatatccactttgaggtaagctgagcattctttaagaaaatcctttctcattaattaaaattttacagagaatgtaaacagtgatcttcatcattccttttactggtttgcaccactaccttttcacaatcatgttcaagttctccagtttcctttgggagaaaatggctcggctctagcaagggcaggttttcctctggaccacagatccctccagtagcaaagcttgatagttaaggaggcgattgtctgttagccagggactttccttagagggcagcactcctgctatattgtatgggttgtaaacagttgtttcccatgggtaacccagtggcctctggcaccaacaaagctgccattgtaactgcttagaggcaggctaaccagcctttagccaccaagttaagttcctcacttaggtaacccactggctgttgagctggacctcaagcttcagccagaattcccagggccatttccttcttttctgaagcatagagactgaatgcttttcctttgggaagactgggggttgatgctttaagtaaggcttgctttagttggttaaaggcaggttcccaagttagtgagtgagttttaactgcttgagtttcgttatgaggtggtataaagggcaagctatttcacggtatccaggtacacacagtctgcaaaatccactaatgcctaagaatcccctcaactgttaaaggaaatgggcatcctttcttcacctgatgctctagtcccttctgataagactagacctaggtactttactgaagtctgacagagccaagctttagattttcagaccctatatcccctttcagctaagaaactgaagagagcctcagtgcctccctgagacttccttggttgggggacagaggagagtgttatttatgtactgcaaagtttcaactcgagggtgagaaaaattagatctttggacagggcctgtttcagcaactttcttcccatattaagggctgtctgagtaataaacctgttctttattgaataaaaaggtttaaagatttttatttagcttttggactatcatggaaagcttggaagagttaataggtttggctctaatcccctgcaagttctccaatatacacatttgaaagagtttccttccccattttctgatgctatcatcatggtcccatttatggtcctccaagggcactggtattttccccacttgcttctccatccctggaacatccaggagagtttaaatacttgggttaaatcttggaaggcctctatacggcagtgaagttggggcttgccccgagtgaactttagggtctgaggactaaaggagatccaggctgcactcaggggtagtgcagacttgaagatggggtgttatccatgtagaaaagaggcaagagaagaggcatccctcagtctccttctcttcagagtgacccaagatggagggaaaggctggaggggcatcccccttcacccccttcctcccgtcctttgggtcccagtgaccatccttcataggtgccgccccatgtttgcaagtatgaccttcatttatggtcctggagaagctagtcagcataactagtcatgctcatctgcttatggccttggcccttcacccttgctggtttcctagacctactttgcccataaggttcccagggtaccctaagggtccaggagagattgtatttgggcaagacaccttaatggaatggaggaagtcttttaatattatctctggcttcccttgctatggccctagtgaaacattgaaatcccagagaatgggaccaattgacttccaaatataaaatcccctttttgtttaaatgccaatgtagttggatgtagaacaggtgcctcagaaaagaacatatgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcctggtagcgggcgcctgtagtcccagctactcgggaggctgaggcaggagaatggcgtgaacccgggaggcggagcttgcagtgagccgagatcgcgccactgcactccagcctgggcgacagagcgagactccatctcaaaaaaaaaaaaaaaaaaaaaaagaaaagaacatatgaattgaatggctgtcctcttgactgttaaagatggagctttgatatttacagatgggtcatggagcctggtccctaatagagggacataggagggaggggaattgaggaactagaggttttcgacaaacagccagcaagactccccatggagaaaaaaatcccatcccactaggtggcgctgtaggatctgagatgttaggtaaaaactctgactccatctatccaggcagaagttagagaggtttggggtttaataggctgtccccagcggaataaaattaacttgtctcataaagaaactgtttaaattcattgggcagtgctgagctttcacgtggagggaagaaataacccaaaaggagaaggaaacaatccaaatggagagggaagaggatattcacttggggtgaaatatccccttatatagtgccatcagtgtctatcattgaggacaaaaagcccttactaggtgaaaatttaaactgatcttgaatttaccctgtctccaggaaatcacaaacacaacaactctttgtcttagtaatcaggaatgtaactcaaagagttgttgtgtttgtcagttggtgtcttagtaatcaggactgactctacccagcaagactctgtctctaggatgcaaaaacacctgtaacattgcatagaaagaagggataagaggcatgatagccctgaaaagaaagaaggaaaatgcagtaggaaaagactggaggtccttgtgccagcaccctgacggctgtcggggactggagataatactgaggggtagccccagccagaaaccttcagttgccctaggacctccttccaatcccatgcaatgtctgggccctttgtgaaaggaaactggattggaatagacaagaaacctcagaaatgaaagtaaaagggtagaggtccgctcttactcacccttctgatgatcccttcttcctgcacctaaatatgttgtagttttgccaatgcaccataatgtagcagtttcttgttctctgaactagtacctggcttctttgtcctgcgtccaagaaaattgagcatggacacaagggtgggggtggagcaaaagtttaataagagagagaagaaatgctccacagcagagaggggagtccgagtggattgccgagttacagctaaatccaaaagcttttgtaagaaactcttctcatctctgtagcagtttgagcaacttctcttatcagtaaagctgtctgtgcaattccccttatcttatgcagctgtgggtatgcctctaggcacgcacaaagtgctgcttctcttgtttaactgtgggtttgttttaggtaagcccccatcctctctgtgccagtttccatggagcccaccatgtatatgcctgaaaaggggaggaaactttttcctgagagctcactaattatggaaagaacaaagggcttctgtactggaccatgtctgcttatctgtgtgtaggtgtagcctgagttttttttttccccaggttgttttaattttacctgttgctgtgacttttcaggcagaccatttctgcagtctgagtttgccccaactgatttttcctttccttctgcctcagttctagagggtatctcaaagtagaaagattgtggggtgaagaatagacattactgagaacaaaatataagaggcatttcaaaaatattatccccaaagcaattcaggaaagaactatggagccgctgttatgtgttatatgctgggaatatggtagtgagcaaaatagctgaggctcctgtctttaatgagcttacagtcttgaaaattttgtagggaagatttctatgcaagggcatagaggtatatacaaaaggatgattattgaaacattattatgaaatcaacagaaatgcccatcaataaggaagtaattcagtagactatggaacagccatactatggaacagccatactatggaatattcaataatgtattgaaacattattataatgttttcattcttattaaaagaattatgtaagtcttatacatgctcacatgggagaaaagtctatacgtactcatctgaacatgtattctatatacataccagacatgtctacatgagtagacaaaatattaaaaactatatacagccaactattaacaatgatttcctctaggagatgagatttgacatctattaggggatatctctcctcctcagaaaagggaagtagaagctcttttagggagaggtggaaaatctggagggaacaagaggattgaatgtgacaaaacctgctgaagagaggcagggagggaactttcacctttatgtcgtaaacttctatgttgtttgaattttgtacaacaaactatgcattactttgtaattcttaagacaaagaatataagtaagaaaaacacataccaatagagttattctggcacacaacctggtttacattttttgaattattatttctaaactatacattggtgaaaggagatggaaacattatacaacacacaacacaaaattatgctctattccagctctgttgtcccctgtcctctgtaagaacgcaaggcctgcagatgttccccaaatggaggtccctaggacagcaaaggtgcccctcaccaccttctgtcaccttcaccccacccttttcctccctccttcagccccttgatgtttctaattccgtcctgtctcccattcaaagtttctatcttgcccttttccccaagttgctatcttctgccttagaagcaagtcccaaatttcctttcatgttttacgtattttcaccaattctggtgtccgttgtaaatcaaaattgctgtctttctcacccagttctgctgttttaagcccagtagttagggtcagaagaagaaaaatgttgcctgagtccccatctgggttatagtttgtttggggggattattatcctcacccatctaaaattaggcataccttgctctgcctgcttcagtttctctccagaaacattacatcttcctacaagatctgcttttccctactactgtgtttttgaacttatcctgaaagagtgtttggtccctcccaactttgggttacactgcaaagtactctttcagaatcaaaatgagtctttaccagtccctgtttggggtttcttctatttaggaagaggcttctggaaactgtactcctgctacagttgtttcaaatagttgtgtagaacaactaagctctttagctaatttaaaagctctaaacaatattatcactttgttcattccacagtaaatttctgaatgcttgctatatgcctcaggtcaacctgtttaatatctttctgaatattttagtaaaacatagcaatatagtgtgtttagctttcaaacgcagtaatataatggtttatttagcaagtgaaataaatctcttgtgccaaaagctcatttcaaaaaggaaaataactaaggtccaggtcatgaaaaaaaaaaaaaaaagccaaccacctgatagctgtaaatactatcttaagtgtcctcagcataaattcacaaattaagtctttttattacagaataagtattggttatgcagtagctttacctaggagtaactttatctcataacagcttctctcttttatcttgcatttctgttaaattttgaaggctatatttcattcacttaccgtagttaagtcgatagtatgtaatccaatcagcaaatatagtcagcttggagccaagcagtatagattacctgtaaataaatatgatgaaattttctctttacagatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaaggtaatggctgtgaaactcacattttgtctataaaataagttaagcatgaataattgcaaaaaggtgatttcaaaataattagctttaaaaaattaatagcatctattgatagcatctgttatcaacaagttgacactgtgccaagcattgtatgtgagttattttgtttaatactaacagtaatcctttcagtggatatcattatgtccattttacacgctcagagatgtacaagtagtacacaaaaatttggttgtacacaaaaattcagtaaagtataccactgattataatgttagaagcgaagataaacataggtagcatgaaaatatcgttcaaaatggctttataaaaaagcttcctccaaaatttaattgagaattcttgcagtctggataaacctttgctggttttgcaaggacatgattagaatcttgaaactgtacacatatgttagcacgaataaatagaaatatggcctatttttcctttcatctctgtgcagctgatccttttattaactaatcatttttaagtatcctagagaatgtatagctttaaaatttttagccatatcaaatgcctttagagtagaggctttaagatactttaaaacttttcttcagttctcatgttaatgtcaaatctaaaagcttttaggcacaacattttatgtatgtccattttgtttatgtccatctttgttgtgaatttctataacaataatgttttcattaaaatactatttctatctcaagacaaatgatactgttggtacaataataattgagatgaacaaaaatctaaatgtataaaataacttttcaaaatcgcccaattttactaattttaagaacctctatattattaataccagtaaaagtttatcatatcctaaaaaaagtgaagatacaccaaaaggtatttagcatcctaaaataactgctttgccaaagaaaagaacacaattttggacctcagagtattctgtatttttttactgttgtcttttttttttatctttacttcttttacaaatctctaatgaagacaatcatgcaggtcccttgagtttagagtaggcagagaagtttgggctacccttgaatgaaagtacagctttaattagttttttcaatttcaaaacaacctgaaaatctcagtcctatccttagtaaaattatatactgtttggttaatcagacttgagtgataatttggtgtgtactttccctaatatattcagaaagtaaaactttaaagatttttcttttaaagactaaatgcatataaaaggagctaactcgtaatagcacttgggtttctgggcatcacagtatcctctataaaggtttggagcttttaactggaacaaattcctcacatacgtgtgcatcagctaactgcgactgagttgggccgaagtaaaagcaaacccacactctcagtggctcgcacaacaaagggttagcttttgctcaaactacacggtccttgtgggtcagcctagctctgcaccccatcctcaccacaggacccaggcgtgcagagcagcctcagctcagacactgcctgcagaggggcagtgggaaagaagacacacacaaccagcctcttaatgcttctatgcgtgtgactgatgtcatttccacccacatcttgttgaccaaggcaagtcacacatgtcctagcctgcagtcagtgggttagggaggataattttcatccgaggaagggcagtgaatattttgagcccttaacacagtgtaccacagtgtgaaatacaaggaagccagaaggtattggatgcaccatttccccctttggtccatggtaaccaagaatcaaaacttgaaacataggccatcaattcatttctgtccataaaaacttaagatgtgtttaacttgtatatgcaaaaaatcctcctaatggaattcaaaaaggctttaaaaaaataatttaggactgcactggactttaaaaaagaggataaaggctttttttttttttaagttgaagggaaaattactcaggttttctgaggggaaaaaacatgattaagcacgagaattttatttataatacttattaaaactgggtaccaaaatagaaagttttttttctcaattccagatacccacgtgtatcttactaataataaatgccctaaaatgagtaaaatattaagtatacagtctgatttgcccatttagccactaactcatctctaaatacagcaattttcctgtgattgcatattcatgggccaaatttttaaacaattttaaaacaattgaggacaatgcttgtgtcctcaagaagcatcttttaaatgatctgcagctcattctgaccgtggtgagctaatttcatgggctcatagtgatacaaacaaaagctgttctcttgtaatgggaagccaaagatggaaattttgccaaatgtgtctggtttttataacacaaaacttcctctactaaattacaaacacatatatacatatatgtatgtataattagaattatatttataatgtataattatacacttgatgcttaagataaagagaaaatgagatttttttcttatttgccaacttggtgggaaccatattcatcataccaaggttacagctttcaacactgattgtggttggggaaagatgtcccagaaaaaaatgttaaataacctataccctgtgtggattccagtgcaattgtatagtattgttagtaggcagtgcatcttcagaaaccctaaccattgcttctgtcaacagcaaacaaaatgttgttcctgaaagcgttcagatttgacattaacatgtgaacaggaacaaaaattttaatatgtcttaaaaccttaactgtcaattcgaataatcattgtttagaagggtgtttgataattctcagactaaccagttctctgtaggcatagtaaactcaaaattaacttaaataatatacttcgccttccttcttgataaaacgtgcaatctggtccatgtaaaattactgtctacccaatgcacctgtattcttgtttcctgagaaaaataataactaattggtttctattcgtctaatttataatatcgattgatttttcttaacagaacacttaaaagaaaaactggatgaatatattaagctgtggaatggcctagtgaaggtatttcgaaatgaaagaagggaaggtttaattcaagcacgaagtattggtgctcagaaggctaaacttggacaggtaggaagcatttgatatctacaatgtcaacattttgggtttggtaactaaatcatacacatttttaatcattcttcagtttttttaattgaaatgagaatgctggcttaaacagataacttatgtgtcagaattgactataatgctaatttttattagcatctaattttaaattgtgtgtaatatatgatgtaacgtatatgaggagtattctttcacctgcctcttttttttaaggttttgatataccttgatgcccactgtgaggtggcagttaactggtatgcaccacttgtagctcccatatctaaggacaggtaacattaccttgctttttttctttcctggttgaaagtaaaccttgtcctagaagggcaaataatattttcatcctttgattccagctccattcagtgcatcgagtgtgctttagtgttatccctcatctatttgtttccttgggtggagctagactgatactgtggactgatttaaatgtaggcagtctggcatttgggagaaacctagggttcctcactcaagaatcattttgtggttgggttattaagacccctctatctccaggcactttctctaagagttatatgaattgctccctctaaactggggtgagagttctaaacacttgaggaaccatgctttgatattatacctgttgatttttgtgccttttaaattagtactttcaatagtaaagaccaggtgttacttgtgtcaaggttttgggttcctatagaaactttaaagtttagaaatagacaactattccatggaattgtgacaatcaccattaaatttccagaaatgtctaaaacaacataaggcaccatcagttttctatctccaaaagccttccttgcttctagtccataattaggaaaataaaacacgtccatgtggcaaatggcaaatggcatgaatcaaaggcagaactttggaggatttaatcatgagaggatttaatgtgaaggccgaacatgaacatttttcacatgctgtctgatttaatcctcacagcaaccctgcaagatagagattattagccccatttgactgaagaggatactgaggcttagagaaattaagtaattttccccaaatcagagagctaataaactgtcagaccaaggcctccctgggaaagtttacactgcaccatgtatttaggaatgtgaaaatcataagtgaggacagttaactgaccaagtgtcaggtaactttctctaggtgaataccagcaggcttctgggcagtgaggaagtggttttccagattccagtggcagattccacaaatctgacaatgaccctccagttcacactctggagagaaggaagcatctttctggactttacttcctccatattaaagttctaagcactgtaggttttcccttttccttggtttttaaacttctgaaaagcagcttgacctggatataaaaagctgtcattttcattttaggaaaatagattttaaaatcctttctgacgagatgaacattgtaacaagcagggtaccagataatctttgtaatgtcactttgacatctaattggttatagagtactagcattttcgtgaagcccaaatataagagattttttgatccaaattctcagaccacttctgaagttcttcagcaagttttgagggattttttttgctttttttttttaaagcaacaataccttttttttttgtttgttttgcaataaaagctgttttctgcagttagaggagtgaggaagatcaagtaaaagtacagaaacacattttcataactgttcccaagaaatagcaacaaagggttgagagaaccgctaagaatgtggcaagtactatctgtgaccccacacacacgcacacgcatgcacacgcacacgtgagctttttcatgggtgatagggaaaataacaggcaagaaaatcttataaataaggtaaaattaccaaaagaaagttgcctttaggaccaaagcgaaaaggagaaaactctattaagctcagtgatatagttctttgtccctgacatttgtctgtaagcctagggggaagtctcctctctcctgcccttacgtaaacaggcttttcggcttttatgggacattcatttactctatttcccattagatattaaagtcccctagtgcacaaacaaatcaacaacaaaaagagataacgtagttaggcatgctgaactagtcttgggttcttaaatgctttttcattttctgtaaatgtttcagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtaaagactattactttattttcttatgttgaatgtttatctaagttcttttttttttcttccccatgaactcgtataaatgtgtgggtccatacatacgcttccatttgatctttgctgccatcaacacaatacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtaatcactaaatcacttacatatttttcttttctccagttgctgctaacctattaacctcttgccaagctaaagattcgttattaaaactgtagatgttgtctcagattctgaaagaacatctttccttacactgtttcagagctttcaatctgctccatttgctccattgtaattgcttttaccctaaatgtgatgtccactactgagacgtacacactttcattggggaaagaaaaataatgtaacatggcatttgttccacgtacaagtgaaaaaaagataaaatcttagttatcctgtcctactggattagacatcaaattttattcttttgatgacagtgtcattctataaatttaaaatacataaattactttaatccaaccaagacttttatttccacgttcatgccgtgggtataatgttaacaatgaagggcactagcaagagatttctgggtttttctccccttttgctgttatgttaactctcaaatactaattttgtactagttaaatctgatgaatcacaatacatgactttaaaaaatgttacatagaatcctttattgcttcattctcagaaaagtgattgattaaaagaaaactctattcaaaaatcagcttttgtcccttcttgtggttctttcagtagaacaacttatgctactctcttcttttgatcttgtaattagaacattttactgtctctgtaaaaagtgaccccaaatgaaatgtttgctcaagtgttagtatagccttctcctgaatgtgtctaatcttatttttctgatcctatggttctgcttttggtctctctctccctgttacactgctggtgatgttagaactctgttttgggaaggtgcttccaatgttatggaaacgctgtgggatttgggcatgtcatgatatcaagatactgaatggcaaacataaagaagttatagcacttaattaatcatagtagcttaattggacatttaccaaattttttttggtaaatttcttattcagaatagtccaggaatcaactgcttacgtgcttaacttaacaaataactgtgggagaaaaaaaataaagggtgctgagcaaatttatatttctgttaattccataggccagtaaagaaaatttttaaagtgacctagaaaaattaaagggaggttatctgttgattaactcactggtgaccatgttaagatgcattttcaagtatatactgagatgaatgggaacatatttgaagaaaaataaacccagctgccgggcaaggtggctcacacctgtaatcccagcactttgggaggccgaggcaggcggatcaccagaggtcaggagttcgagatcaaccttgctaacatggtgaaaccccatttctactaaatatacaaaattagctgggcgtggtggtgtgtgcctgtaatcccagctacttgggaggctgaggcaggagaatcgcttgaacctgggaggtggaggttacagtgagtcaggatcacgccattgcactccagcctgggcaacagagtaagacttggtctcaaaaacaaaaaaaaaaagacacagctataacggaataatcttaaatgacagttaaataaaggtgacatgaaaatatcacctaaaatgtaatagtgttgttactgtgttaggcagcatattttaagaagaaaaagcatgagagaacaacttttttctgatgctattttcttctagtattgaaaatatttcttgattcattatccactcaacaaacgtttattgaatgcttactgtatgccaagcactgttttctggggatacatttttaaagatatgtttcctcattgaatttaaaatacagtgaatcagacagaaattaaacagataactgcataaataaccctaaaattagcctggtgtggtggcacgtgcctgtagtcccagcaactcaggagactgaggcagagggattgcttgagcccaggagttcaaggcttcagtgaacaatgattgtgccactgtactgcagcctgggcaacagagtgagaccctgtctcacaaaacaaacaaaactctggaacagcagctgtgataagtagtatgaagaaaaatcacagagtacatgagtttatggaaagatgaacctaatccagcttgggagatcaggaaaggcccttctgacaaagtgtcatttaggctgagacctgaaggatgagggaccaattctgtggaaaaggagaaggaacatttcaggatcgtgaataacatgaatgaaggccttaagacagaaaggaggctggcacgttcccggtgggagcagagccgtgaaggactcaacgggaagagagtccatggtgagcccagagagccgggagaggctggtatcatgcaggcgcatgtggaggagtctgctctggcccctgtgtgattagccttgagcagggggcagaagacaataaaggacacaagctcgggagatattggaaagtccaagcagtgttggcctggtctaggctggtggcagtgaagttggaaataagtcagcagattcaagatgtattttcaaggctgggtgcagtggctcatgcctataatcctagcacttagggaggcctaggcaggtggaacttttgagcccaggagttctagaccagtctgagcaacatggcgaaaccccatctctacaaaatacataaaaaggtagctggatgtgttggtgtgcgcttgtagtcccagctactcaggaggctgaggtgggaggactgcttgagcccagaaggtcaagactgcagtgagccgcaatcatgccactgtactccaggctgggccatagagtgagactatgtctcaaaaaaaaaagatttttttttcaaggtagaatcaatggaaccttgaaataggttccattgaacctatttgagtagattgaatattatgtatgatgatgaagttaccctaataatactgagtaccctaaaatttaagaatcatgatggattagtaattaattgttcaggggaggggagcagggagcaagataaattctgctgtaatttctcccaatggtgggagtgacttgtccctaagaagctaccaaatcttttttctcttggacctaaaaagtgtccaatttaagatccattcaagaagccccacagatacacaggtcacccttttgcattcctacctcctggcacagtaaatatctatatctaattctcctgtgtcatttctgtgctacatttgcaaactctgaatgaactgtggttgttctacaatgatttacactgttatttggcgagcccctgagctataaaattaaaaaatgacagactacttccatggtgtatggttttgttcacccaagaatgactcataaatcaatgcaggagcagttagcagaccacggctgtatggctcagtgtttttaagagtgaaagagaaaattctattttaactaaaactaaggcttaatttttaaatccacagaggtaccaaggcgccctctaatggtgaactcaaacaatgctctattttgtaatgagctacagtttcagttagaaattgtggtaaattcgttagggaattatgaacagatttttttctttttttgtaaaggctttataatttcttaatgtttggccatcagttttgtctcttctatgcattttcaggctgtattctacaaggcttcttgcctattggtgaagggttattgggggtttgtctgtaatggttattgcagtgtttctttttcttaggtccccagccatggctgggggattatttgccattgaacgagagttcttctttgaattgggtctctatgatccaggtctccagatttggggtggtgaaaactttgagatctcatacaaggtaacattttatttcaacagatggaattctccaagtcgttactaacttctgtggctttcagataaagctagttttttgtgggggaaaaaagcccacaattatatcatgcatttctccaaattgtatagaatgatttaatgaaaatggatgcctttgaggaaaaaataaggcaaaatgcaagctccaaacttaccatatatttacagggctcagctcaaaattgtggctagcaagctttagaaatgaaaatatctacccccacaccccaactttctatatattggagctttttattatagaagcccttggaagaatctgcatgcgttagggccacaattgaccacccactgacacagtcaccctttaccactgtaggacatgattcaagacagaagcagagccccacaatgactgtatcctcaggctgactttggcgctgtcttcctgcagcatccaccctgttgttgaagcagtctgggagcaatactatcttccatgctccagcccccacctcaacccctattcctacccccattttccaaaagaaagagagagagaactatatcagagtgtgagttaaacaggtattcattacctcttgtcttaaatgtcctgtgcgtagcactgtgagggatagaagaggagtaaaccagttgttgctctcaaggaacttgataagaagatattagaattatacttaaattcataatacaagaaggcagaatggcattcagttggtgtgcttaaaaaaccgtcggccaggcgctcatgcctataaacccatcactttgggaggccaacatgggcggatcatgaggtcaagagatcgagaccatcctagccaacatggtgaaaccccatctctactaaaatacaaaaaattagccgggtgtggtggtacacacctgtagtcccagatactcgggaggctgaggcaggggaattgcttgaatctgggaggcggagattgtagtgagccgagatcgcaccactgcactccagcctgggggacagagcgagactccgtctcaaaaaaaaaaaaagaaagagcgagcgttatgctagatgcagaatttgcggcagaagtaggaagatgggtatgatgttagtaagcacagataagggatgggagggggacttctaagcaagtagcatggggaaaagtacaaagaagagaacacaaggaacattcagagaacagcaaggagcaaactttggcagaatcaagcaacatgaataaggaagacatctaagaagataaaatgggaaggtgtattagggccatattgaagagagcctttaaagctgagttaagagatttttatttaatttgataagcagtggagaacgatcaaagatattaagcaagggaataacatgacccaaagctgcccttcacctataataatctcttgctataaataaggatagttgagtagagagaagccgaaggtgaagaagccagttaggagtttattataataatcacccaagtaggaaatatattagcaatggaaatgattaatgagttaggaataaagaatccacatgactttgcaaggttatattgggagaaagttgctaggggctatgagtacacagtaagaggccccttagtagcagtttattattaatactgtattccctgttgccttcttggttgttacatgagcttttaaaagcaaattattttaggatttgtttagtttaagaattctgtgtggacactgtatataatttagattttagatttacacttacaagataaattttcagttatggtttatgtttgtatttgaaacaactttcacaacgtgtttttccttcatagatatggcagtgtggtggcaaattattatttgttccttgttctcgtgttggacatatctaccgtcttgagggctggcaaggaaatcctccgcccatttatgttgggtcttctccaactctgaaggtgagttttttggataaaaggggaggacagggaactaacatttatgtaccacatgctatagtagttacttaacaattgtcagcttattgagtgggctcttcagcagtcatgttgattctcacctttaacttagctagacttattcacgaaatatcttattgttctttaagattattcagctgaagcaggaggattccttgagcccaggagttcaaggctgcagtgagctatgattgcaccactgcactccccgctggatgacagaacgagaccccatctcttaaaaaaaaaaaagattgcaccctatttttttaattgacaagtaaatattgtatgtatcttgtacaatatgatgttttgatatatgtatacattgtggggatggctaaatctggctatttggacatgtattacgtcacctacttgtttttgtgctgagaacacttaaaatttgttctcagcaattttcatatatgtaatatattataaattgtagtcaccatgttgtataatagatctcttaaaactattgttcctaacagaagttttgtgtcctttgaccaaaatcagcccactccccccaatcctcaccttctggtaaccaccattttactatctgtttacttgtttacactccacatgtaagtaatatcatgcagtgtttgtctttctgtgcctggcttatttcatttaacataatattctccatgttgttgcaagtgacaggatttttttattatttaagggtgcatagtattaataccatcatgtatatataccatattttctttacccattcatctgttgatggacacttagcttgattccatatcttgactatcgtgaatactgctgcaatgaacaggagtgtagatacctcttcgatatacagattttatgtcctttggatatatacctagtaatgagattgctagatcagatgatagttctatttttaatattctgaggaacctctgtactgttttcccataatggctgcaccattttgcattcccaccaacaggtgggaagggtatcttgtggtttaatttgcatttctctgataattaatgatgttgagcatttcttcatataactgttggctagttgtatgtcttcttttgagaaatatctattcaggtcctttgcccaatttaatcaggttgtttccttactattgatttgtttgagttccttctatgttacggatattagcccttaccagatgtatggtttgcagatgtagcctcccattccatagattgtctactttgttaattgtttcctttgcttacagaagcttcttagtttgatataattccattagtctatttttatttttgttgcctgttcttttggggttgttacatccaaaaccaatatcatggaattttttcttttagaagtgttacagttttaggacttcacgtaagtttttaatccattttgagttgatttttatatatggtgtgagatgaaggtctagtttcattcttttgcatatggatatctagttttccatttattgaagagactgtgttttccctcatgtgttctcagcatctaccttgaaaatcaattgaccataaatgcgtggattatttctggcctctctgttctgttcttttggtctatgtgtctgtttttatgtgagtaccatactgttttgattactatagcttagtagtagattttgaaatcaggtagtgtgatgcctccagcttcgttctttttgctcaagattgctttagctattcagggttttttgtggatccatatgaattttaggatggatttttttatttctgggaaaaatgtccttggaatttagatagagattatattgaatctgtagtttgcttttataatatggatattttaataatattagttctttgaatccatgatcacagggtatctttccatttattttgtgtattcttcaatttatttcatcagtgttttatagttttcagcatgtagattttttcacctcctaaatattttattgttttgcttagctattgtaaatcggattgttttcttagtttgttttacagatagaccaccgttagcatatagaaacactactgatttttctatgttgattttcctgcaactttattagatttgtttattagttctaacagctttttaatagagtctctttagggttttgaatatataagattatgtcatctgcagagacagtttacttcttttctgatttggatgtcttttctttctcttgtctagttgctctggctaaaacttccagtagtatgttgaatagaagtggggagagtgggcatccttgtcttgttcttaattgtagaggaagagctttcaacttttcatcattgagtataatgtttgctgtggacttgtcatgtatggcctttattgtgttgaggtacaatcctcatgtaatttgttgaagctttttacattgaattttgtcaaatgcctttttcacatctattgagatgattatatggtttttgtccttcattctgttaatgtggagtatcacatttactgatttgtgtatgttgaatcatccttgcatcccagggataaagcccacttggtcattgtaaatgttatttcaattatttctctgtgtttgattgaaggtaactgagcttctgtaaaacaattatttagaattatttatccaggtctactactgggagattattgtgatcttctagtggtattatgtcctcttcatttttcagtttcttattgacttacattaatgcctgtgcattttgtggaccagtcacctcttgcggactttacaggctggtttcagcttcctctatgggggaaggaaggtgtgagggtacttgcttggtgggatatagcagttctgggactactgaggataccaggtatatattccctgtgcagatcagcccaccaaggtcagtgttggcaaagattctagtgctcctcagtggctaatgctgtagatatctatagtggcagtgaggcatgttggggtctttgggtatggctgccaaggtcatcctgatttttctctcattgcagaagttgaatgccccttggcactggttctgactcataggctcacttgcagcggcagtggcccttgtagagtggctggggagctgaggactgaagcacaagcatgagtggagagactatggctacaggatcttggacagtttaaaaaccccaggacttagggcacagatatttcgctactgtattgataacagaatgcgaggtaccagatgtttgtgagacagctgaagtagccaagaatgggagcacagatgtgctcagagttaatccagctctagggacagagtggtgcctaggtctctatggcagctgagctggtgcttgggacataggtacctctgctgccatgttggtagcagtatgtgaggcccagatgcttgtgaagtagcttttagagccaaggaaaggagcagaagcatgcgtagagttagagcagctcctgagttggggtgggttctagctctctgttgcagctgatccagggcctggagatggggcatgcacaataaaggcgtggctctgaggcctggagcatgaacgaactatagcaatggttctagtgtcggggcaggcccagtgcagccacagagcctggggctgcaatgtggacactagcagaacaactgtggcttcaggatcagggctcactgggccatgggagaattggcagagctttgcccaaagtaattcaagagtagctgctgcttggatggtggtgaatgttcagatgcatctccctctctggggttccccagcagaagggctgtcgtttacctcagtggcaagtgatgccagtgtcctctagggagcaggcctctggaaactatggtagttcctgctgcatggccgataccaatagcatctgcctttcttctttgttcctagctatctccttgtgcctcaggtatgtagacctcacaggtgatcctgtcctatgtagatattcttcgtttcttttcctccattgtgttgctgcagattcttcaatgggccctggagctctctctgggctatttgggtttgtgaataggtgtctgtatttgttttttagttgtgggggaataaaggctggtgtctcctactttgccatcttggtgacctcacctcccattatatcccattctgattaagattcctatattgaatgttctccatgaatacatttcaaataaactcaaaaaagtctgacactgtgtagggaaatagttgaagggaaaaatactagcttctgttattcacacatgagtaaaatatggtttggttttttttttaatttagataatcatgttaggagtttgcataataagcaaaatcgaatttttgaacagtgcttacaaaagattaatatctcttgtccctcaaagattgaaaagttaatgtgaatatcctttgtcctgttgtattctgcctccatattctctatctctgtcacataaaatagaggaaaattggccaggcacagtggctcacacctgtaatcccagcactcggggaggccgaggtgggaggatcacgaggtcaggagttcgagaccagcctgaccaacatagtgaaacccagtctgtactaaaaatacaaaaattagctgggtgtggtggtgggcacctgcaatcccagctactcaagaggctgaggcaggagaatcgcttgaaccctggaggcagagtttgcagtgagccgagatctcgctgctgcactccagcctgggcaacagagggagacttcgtctcaaaaaaacaaaaaaatagaggaaaatcccactgactcttttcattgtgacatccaaattgttctattgtaataaatattttgctgtgattatttaataaaaatctcatctcctatgccataaatatagaactaggattgataatctatattttaccaaaactcatgaacctgcagaaaaacaaaacattggtttttaaaacattttggaaatgttaaaaaatattttttgaataaataaaatgtatttaacttaaactgaacgggactgttttagtaggatgagcatcctcccgggcttctttcccagtcacacgtttattaggaaataaatcacagttctagttccttctattgattctccccattccagggagtgtacgtgctctctctcagcttcctcaaatgagatatgtcatagtcgccgtcttccaagagaatgacagtttctagctggggaggacagaattagaagtagtgtagtggtgaatgatgacctggtgattatccagccatgttggggtctcccagttctttgacatttcatcccagactagtgacacttaggggtggcatttatttatgaaacaaaccaaggaagcttcatgcagacatccagatgtcccactgcttggaggacaaagacctctatccctggcaaaacaactttgaggtttatttggttgggctgctttcataagttctaagaggcatgcaactctgatgcccctcattttctggaacgcttaaccaagtcaagtttattgttggctgtagacacaacttgggacagttcataaaatgggaataggtaataagcagacagctaagctttcagagccagaacatccttctcattggccaaatgaagccccagctacaacaggggatgagatttaaatgtctgtgataaaacaaaaatagcaccaaattaacaccaggcatgattgacattgcaggaaattccccttggagttggactcaacaatcacgaagaattgatgaaaagccaaattgactcaaaaaaagtctattctgaaagaaaaactaaaagagctgagaggtggctatttatcctctctaaaaattagctatatataccatacaaactacccagtaagtgtgaatttagcatacacttagtgagtacccagcatgtgccaggcactttcttttctccagttttgacagcatctacttgagccatcagggggccagtggccaggtctgtttctccagctcatttgtctcctctgagcctcaaaccttctagagttatcctctttgatgtcctttagatcttccactcaacagaagtcaaaactgacctttaacttttcctcaaaagtgattccttccactgtgttctctatttgcccgtgaatgaaacttagggaggcatgtagagttgttccctgtccctcccccttaccaagtgctggtgattctgcctcacatatagctcttcaatccatccctttctatacttagtgcagcccctcaaatctctcccatgaatagtaaatagcctcctacttggctctttgccatcaagttcaacccccttcagtctaccctccactcactaccggtgtcattgatctgaaaattaaatctgatgtcacttacctgcttaaaacgtttttatggttgtcatctcaagggtaaaattcaaagttcttttaaaaataataatattaataatagctaacatatggtaagtacttacagtgtaccaggcataaatctaaatcctttatatagattaacttcttaattttcacaacacactatgaggtaaggactatatcctcatctaatttttttatgttgttgttgttgttgttgttttgagacggagtttcactcttgttgcccaggctagagtgcaatggtgcagtctcagctcactgcaacctctgcctcccagattcaagagattctcttgcctcagcattccaagtagctgggattataggtgcgcaccaccacacctggctaatttttgtatttttagtagagacagggtttcaccatgttggccaggctggtctcgaactctgcctcccaaagtgctgggatcagaggtgtgagccaccacgcccagcctatatcctcatcttaaaatgaagaaactgaagcaagttttctcccagtgaatactgcattccagtttttgtaaactacttgctatactgcaatacaccatgatttgtcatactgcatttgcttttctctttgccctgaataccattcccacctaattaaccactccttcgagatggggcaacacagtgccactctggccctgtccatctgagaaaactaattgctccttctttttgttgccataatcttacatgtgtatacataactcttcaggtttgttcatgtctagagtacatgtactgtgtctaatttcgtatggatttgcaaagattcagaatgtttagtggtatattagtctgttttcacactgctataaagatatacttgagactcggtaatttataaagaaaagaggtttaattggctcacagttctgcaggctgtacaggaagcttggcagcttccgcttctaagaaagctcaggaagcttccaattatagtggaatgcaaagggggagcaaggcgtctcacctggtgggagcaggagcaagagagagaagcaggaaggtgctacacacttttcaccaaccagatgtcacaagaactcagagtcacaaggacagtgtgggcatgggggtggggggtggactggtggtaaatcattcatggaggatccaccccatgaaccagtcaccatccaccaggccccgcctccaacattggggattataattggtcctgaaatttgggtagggacacagatccaaaccatatcaagtggtaatatcgtatgttcttttatcatgctgcttataacagctttttttaaacccatgggcttttgtgacaacaatgcatctaggggcatgttcaccctttgatagttatcttgttgcctagaaaacatttaatctgaacactaggtatttcttttttgaatgtaaaacatgggtcggccacatggctgacaggccaaatccaaccctttttagtaaatcaagttgtattagaagatagccacactcatttgtttgtgtattatctacggttactttctcactacaatagcagagtcaaatagttgccacagagactgtatagcccaaaaagcccaagatacttactatctggccctttatagagaatatttgctgatgcatgatgtacaagattaagggattgagtattattttagttcatttagtgttgctacaacagaacacctgaggctgggtaatttatcaagaaaagaggtttatttattcacgattctggtggtttgaaaattcaggcttgggcagctacatctggtgagggccttatgctgcttcagctcatgatgggaagcagaaggggaatgcacatgtgcaaagagatcatcacatggcgagagaggaagcaagagagagaccaaggaagccagactctttaacaaactactcttgtgggaacgaatccacttctgtgagagcaagaactcaccccctcacctccataggaggccattaatgtattaacaacccaaactcctcccagcaggccctgcctcccagcattgccacattgggcatcacatttcaacatgaatgttggcagagacaaatcacatgcaaattatcactcaagtgtgtaccaatttggtcacatatattcatgcaaccattcattcatcaattaaagctttaaaagctagatatttgtcagctatcacagtgtcagcatattttattgctctatagctgctttttcttaaagtgaaccaactggggtcgggggcaatggctcacgcctataatatcaacactttgggaagccaaggcaggcagattgcttgaggtcaagagttcaagaccagtctggccaacatggtgaaaccccatccctactaaaagtacagaaattagccaggtgtggtggcgggcacctgtaataccagctactcaggaggctgaggcaggagaatcgcttgaacctgggaggcagaggttgcagtgagccgagattgcgtcactgcactccatccttggtgacagagtgagactccatctcaaaaatatatattttttttaaattaaagaaaggaaccaactggggaaaatacccagtccatttggggttatagtaaaatagttctattatagttataacaggatcaataaaatcacctgcaaaaatgtgttttattaaacagagcttttgtttctcatgatggtttctgaaatgatatttttttccctacacttatcaacagaacgattctaatagaaagagattgtaggccaggcacagtggctcacacatgtaattccaacactttgggaggctgaggtgggaggatctcttgaggccaggagtttgagaccagcctgggcaacagaatgagactccatctacacaaaaaaataacaaaaattagccaggtatagtggcatgtacctatagtcctagctactcgggaagctgaggtgagaggatcacttaaacccaggaagttgaagctgcaatgagccaagattgcaccactgcaccctagcctgaatgacagagcaagaccccatcacaaaaaaaaaaaaaaaagaaaagaaaagaaagagattattatagggaaagaagtacagtgtccagccaagctctcataaactctctctgagattcaatttattcttctgttagcagaatagaatacattatctcagcatatatgatcttccagctcagggatatcaggttttgtacaatactttttacttaaatacacatgatattttaatccttggcagatgacatattagagtcattaacttgcatttgttgtttaattaaatgccaggtcctgttgaaatgaatttgttatgtgtaggccattttcatgtgtctaatataggctgtttatgatatgacatttgtatttttataacgatatatatatatatattttttttttacagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaagtaagtagtcacatctcaaaatgtatgtgtttgtagactgagtttgggagaaggcagagagaggtggaaatatgtaagagggaagtattcttggggaaaagttggggtaaaaactgtctgataggatctaccacctttccactaaacagctatagctgccagaccagctggccaccatgctgtctcctggcagcctttgctcattggccccctagcctgcaagacatccactcttcactccagctcctggcgcctccatgcctcttactccaactcccttccttaactaatttcaatttatcttactgctctcaacttagagatcaccaatactgaaaagcccttcttactattccccacttcatcaaaaagatgcagttctatgttctttccaggggttctcacaacacccaaaatcacctatctcccaaccagtctgagtgcttcaggaccttgatcacttgtgtccaggtggactgatgcagggacccatatacagtagatactccaacaatgcttttcaaatgaattaaaaataattaaaatcagacaaaagcactttgacaatcagacattgtcatttctttgtttattcaaacttgtcttcagactcacttctgattgctccctgcagccccgctgtatgcctcacaggtacactaaacctgccatgaacgttcaagtctacatccctctgcttaattatgttcagcaaatattggttgagggcctactatgtgccagtcactcttctagacagaaaaccagagaagcaaagtcgtttttctcagggaactggcatgctacctggggagagagaccaaaaaagtctgagaaaacaaaaatgataatgacagatggtgataaatgataatgacacataatactgtcaagaggacttaagggcagggtaaggaaagcctctctgaggaggtgacattcgctctcagatctgaatgataaagagtcagccaatcagagagtggagatgaagggaagctgaccaactgcggaagcatagttcatctgggagtggattccttatgggttggtgtgtgaagggataagggccagaatgacatcgaggttgttttgagtagctgattaggtggctgctgagattgggaagatagtaggggagtgaatggagggggcaaggcttctgttggtgttctgggcatgtgaagtacctgctaggcgtccaggtagagccattaaggcctactgatcatagattgtaggttgtatgatgccaaagtccagaagagaggccactctggagatgtgcatttggggccatcagcaggtaggtcgtttcatgggactgaatgaggtccccgagggagaaaacacagatagagaagagaagactagacccatccgtcagaaacgccagcatttagagttcaggaatagaaggaaaaaccaacagaggacactcatgctgctctctctgtacttcttgctttaatatactttttccctatactcttattttacctgtcctattacagcaaattatgtttaactccaactagaccataagcctttcaacacacagatctctctctgagggcccagacaagtatatccaactgtatgcttaacatcaggacttgaatgtgtaacaggcatttcaaactcgacatagcctaaattgaacttcctatctcctccccccaacccatctttgctgatttcttggtcaaaaactttggagtcttccatgaatcctgtctttgtctcgcacttcatatctagttccagaatctgatcccttgttgcctggtctaagccaccatcatctctcactgagactaacttgttgactctcctacagcctatttcaaatacagcagtcagagtgactgttttaaaataaaggcaaatcatgtccttcttctgctagaaaccctgcaccttcacctatgagtgaagacaaagtcctttctggtagtctccaagatccacaacatctgtccccattcctctctggcctcacctgctactgctctccccactccactccagccccatgtccttactggtcctcagactccctccaggcatgtgcctgcctgtgctgttccctctgccaggaatgcttccttgcagatacacgcatgcatggccagctctcacacctccttcaagtctgctgacctaccacttctcagtgaggtccaccttgttacttcccaacgccctagctcccaccctaacttcctcttcttttcctttttttcaccacacttatcaccttttgccataacagacaaattgtctactatgttttttaacttatattctgtcttttttcccttacattcccagagtgaatggaggcaggggcccacattcactgtggcatgcccattactggggtaggtgtctttattttgttcactagtgtttcagagcctacaacatgcctggcacacatcaggtacttaatatttgatgattgaataaatacatgaatgaataaatggaattttctgtcctccttttactgtctcactcccaagtatatcttcagtttaacctcttcccattctgacatctgcactttatacttcatttctcggcatttccttaacattccagggtaaacccctacctgttttaaaggtgtctcttggggcagtctttggagctcctccaggcagggtgagcagctcttcctctgtacattcacacctctgtcctgactggtccactacccctctgtctctctacaggcggtgaggaccatgacttgcacctcttcatatcctcaaaacctgttatcattataggtgcacagtccatatttgctgactgaatgcaagaataaaacattttatccaaatagtatagcgatttataattcagagaaataaatggcttttccaaaaatagttcttttcatacaaaatgtacattccaaagatggaaacctgtgtttgcttttcatctacgtttatagagaaaagcctcactgcctggtcatgtgccatgcatggcctatgcaccctagacccctacaggcagctaccaaaagtgctgcatagccatttgggagaggtcccttacaaatccagtctgttctagatatctagggccaggccagtgtttattaccactgtggttaggttctctatttgcttctcattcacatgaattactgtgattctgaaattgcaattaatggtaactttttttttctctgtggtattttacggaaatgtatagtcctttgctcttagagaaagaacccattccagtgttgacttcaagaccataagttatttcaaaactatgtaaagattgacaatccagtaataacctgtcactacacatacccagattttccctgtaaactgtaatatttaacatgaaatgttaaattctgatgccagagttcatcaaaaactaaactgttgcctgctttttgcgtctttattcatttttttagatcagaggcttcgaaactgcttactgcattgatagcatgggaaaaacaaatggaggctttgttgaactaggaccctgccacaggatgggagggaatcaggtaaaccaccttacttttgtgtttaagttgttccgtattgagggccatcaggtttattgatcacagagtgatctttgtactttggttttcgatttggtaattttgtttgttttgataaagtaaaacattctgtaaaaaaattgacagtgttaaaacattcacttaaatgatgggaataatagcagtattggttttcacataagcagtcagaatctagaattaatgtctaatataagggattaaaatatattcctgtgggagtatatatttgtcactaccgtaactatgtaagcctagctccctaacaattttttgcaagtattgctcactaatcctcatctttttgcaaatagagtgttactgccagtaatgtatatttcactaatatatattctcttacttatgtgggtatgtttttgctttttcattttttcacattgttggtacttaataaatttgtgttagtgacccatttggtatcttagagactaaagaacttaatgatttcagtgttaataaggatcttcactaacatcaaaataaatataatttgtctgtggacttacagttctaaacaaaattatggaaaaataagttagtcattcaatttaattataggagttaagtttctttcttttcaaatgcacatcagcagggaaggtgcctctgttacttaattctctcttttccttttacagcttttcagaatcaatgaagcaaatcaactcatgcagtatgaccagtgtttgacaaagggagctgatggatcaaaagttatgattacacactgtaatctaaatgaatttaaggaatggcagtacttcaaggtattctgcattttaacttctgaaatattatatgcttttcattttcagtaacatctagcatgtggaatttagataaataaatcttaaaacctgcattcaaattcacttgcattttcctctcatttagtcccttgcataggttttcctgagcactggatgactcattgttctataatgaggcatcacttttgttctctcttacaatattgtcatgtaatgaggccacgatgatgtctataaagagcactgctaattttagtaatacaagaaagtcagtgttctgtgaggcagtcatcaccattgctctcatcaaaatctgatttttgaaatgtaaatgaatcattcattaaagtaaaatatatttaaatatatttatactattaaaaatttggttaatatttgatattgtccagcaggtggagatagagacaaacaaataaaacttgaaatctaggctttcataacgtctttatcattgttgtgtgctaaatacagtgggataaatgtagctagttgcttactttaatggtcaaatttagttattcacgtgacactgctggggtagctttgtgtttcagctgtgagtatttaaagctctgtggcaagttgaggattacaacatattaatagatttatgtatagttttcaaattctagatttggctaacataaatcaatttattattaaacaaaaagtggggaaagctgcctcacactaaaaaaatctgtcaaccctccattttatttactcacccagtatttgttatcatatcccatctgtcatgcaagcaaggacttgtttgctatgtaataatgatatgacctagcttaacattccctgttactgtcatttacagataatttccaggaagtgataagcacgtatcaattgatgattttgtttcttataacaagttaggaaggagaagaatagcataaaccttaaagagtggagcatttattttcacaaaaaaaaaggatatataatagcaataaatagtaggggtcagtgagaacaatattagcaaaatagtaaaagagggctaacacaccagaaactacatcaagaagtaattgaacaaaaaatgacacataacatgttttaggtattttaaagacgcagcactgaatatacatttgtgtgttagatattactgaacattcacttggggaccaataatatgttagactgtaggggagttcaaaaatatagctaaagcacgctattatataatggcagagaagaaagaaatgcaaaaatagagataagcaaaatgccataggacagaaaagagtgattcatgggaggaattactgctgaggagtttcatagaggaagtgtcattgcacaagtcctgaagtgtaaaaaggctttccatggaaagtaaataagaaagcctggatgagcaaagatgtggcatgaaaacatgtagaaaattcaaagaattgtatttcatttggtatccctcaattgtgctttggaggaaagagcaccgaacttcattttttaagttttggagagggatagaccttatttgaggaaggtagtgatggaaaacaatggctacttttaggaaaataattctggaaacgtgaggtatggactgatgaagcaacgagatcagcttgagcagcagttctcaaactttctgtcctctggattccctttacactcttaaaaatttttgagctcccccacccccaaattgcttttgtttatataggttatcactagcaatatttccagaactggaaagtgtctgagaaatttgtaaagtttttatatattaattcatctaaaagtaataataatatacttattaaacattaatgtaaatgacatttttaatgaaaaataactatgtttacccacaaaaaatagtgagaagaatggaattctgtatttttgcaaatctctttaatgtctggtttaatagaagaagacagctggattctcatactcctgcttcatttggtctgatctgaaatgttgttttcgttcaagtatatgagggaaacccagccccacacaagcatacagtttgtaaagggagcgagtactttaatagccgttcatataattgtggctgtttttttattgtacaccacaacttaataattaagtggtagtttcttaaaagttatttccagtgtagactgatatccttgagcattgtacctcattatatggaagtacttgatacgtacttcccacttcatctcatagaattttttttaagtatactgaggggtcaagactgaataaaacgaatgttttgctccttcatcagtgacatccttaagtgaaaccggcatttacttttcaactgtgtgtggccatgagcaatacaactataggtactagcatagtttgattcatgctaaggcaccatcagttttactcaccattgcttttgcactatcggtataaatgttgctaaagtgaaaaggcaatggtgtcttcgtattatgatgaaaatagtttcggccttacagacccaatcctggatagtctgaggaccagactttgagaagctctgagctatattgaagaaacctacagcatatggtgagggccaaaccagggcatctgcagtggcgatgggaaggaatataaaccagagacattgcacatatccatccttagtgactggtatgtgagtgaatgaggaaaagtgcagtatttcctaaggactagagagctgggaatgtcattagccaggataggaacaagagacatagatttggaggggcagataatgaatttaggtttgtatacattgagtgtgagataccagcagtatattgtgacttaacaatgaaagatcttaggacttagaaaactgacaatcaagagaaatccagaaaactgacaatcaagagaaatccaaagtctgaggtgtggttgagaagcttttccatttccttaaactgtctcctcatgaaagtcaagtgatgatttctgatgtcagtgatatcaagggtccaaatttgaaacttttttcttactgtgttttccagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattcatgggtttttttggtgcttgtaatcatttcaaatctaaacactgcacatttgaaagaattacttgattttactatttacaagacacacaatacctaaaatattatagaccatagttattagttgagtatgtgcttgactgttgcttagcattctgttacacatgcttagaatactcagagcttatgtatctgttggaaggaaacaaaggtttatttttacctgtttgcctatgtataccaattttttaagtttatactttttttaattataaaaaattaccccagcaacatatatccttcttggctgtatatagaattgccttcttggctgtactatagaattgcctattagaagcaaacatgccttcaaatcaaatttgtttacaacctgacagatcaggttaagtggagaaaaatgaagagaagggaagcctaccacaatgaaattagaaatagtccatagcaccttgtacaaaacacatctcaagagaagatacggttgctaacagattcaagtaagtggctgtattgatttgggaaactttctctcaactgacctgtctattgtcatatctcccaattcttagctgctgtagaagtaggctaagaaatttgaaaaagtgacagcaccagactagaataaatgggagtttctttatttcttaagtttctcatagggatcttggaatatatttcatttctggacataattgggaaaaaaatccatatataattcaatggaaaacatgacaagtacctcaccagaaagccagatacctaataggccaatagtttaggtacgtgaaaattattccatgtgaaagcactttaagaagtgttgagcattatgaaactgtgatgtgataagtgcatcttgaagaatatctaagatattgtatccttcaaattacctttaaatgaaatttctcttgggcttttggtttgagcaaataaaccacagctgtattaagaattaactaaccgaaacaaaactaaatatttgaatagaaaatagggatgaatagacttccacttccggctataattttaagtggacttatcttgctaccccaaacaacagttaatgctggacaaaatatatgaagcaactgttttcaggaattggatactagtcaaagcagactgatatctaaaagaaaggaaatacacaaggtgaatcccaggttcaccatgtctgtctccatgggaggacattcccaaccatggtgcaaggaatgcggctcagaatggtggtattgctgaactgaggaggcggagtggaggtttccggctgctgaaacagctagaatctacaatccaggttattggaggggaagtacgcttgagtgtcaggagagctatacaggaatttttataccacagccatttgcaatagcgaaaaccctggaagcaacctaaatgcccattgacaggagaaaggatgaattgtgatataatcacacaatggaatattacagagatgaatatgaataaactagttgttataaacaagttttaggtgtacaggattgaatgaaaaaggcacttcccaaaacactttattcagcactttttatcaatctcaaaagtgactaaaagtaaacatacagtatgttaatacatttatacatgataggttaaataacttgtccaagttcacaaatttagtactggggtcaaggacataatcaagtccagtactcaatatccctctaactctgtgggatgaatatttatttggtgccaggaaaaactctcctaaagaatgtatgttttccacataacttctttaattttcctctctacctagactatcaagaacctcagggctggaacagtggctcacacctgtaatcgcagcactttgggaggccaaggggagaggactgcttgagtccaggagtttaagacctgcctgggcaacatagccatgtgtggtggcacacatctgtggtcccagctgcttgagaggctgaggcagaagaatcgcttgagtctggaaggtgaaggctgcagtgagctagaactttatctaatactccatcgtagtatctgtattaacccatgtatatcggcatatatacttttagctaatatttatcgagcatttactatttcttgccaccaggataagtgtcttaaatgtattactttacttaatcctcaaaaacattcaaattttacagatgaggaaaccgaaatgttacatgagttgtctgatgttacaaaaccagtaagaaaaacagagccctattcaaatccgtgattcactaccttgcttttaatttctttcataaccttgtttttttctttgtatattttgttcttgtttttctttgtataagccattaatattttttggaaaaaatttggagaatcaaagaattacacaaatatgaatggattatggtattttactatctcttatctgcccgaggacaatgtccaagttgattgtcctgcttttctaatgaaagactagatgatataaaggccatttccagttccaaaatttagtgctacataatgctgaaaagttatttttctttccttttaatgcgacagtctattgcactcctgagttactattctatagatgtggtaacacctaggatgaggatcaccagaagtctgcactgttaactcttgaagaataaaggcccaggagcacaatgaagttcaattgaaacatttttatttacctttgctgcagggtaagttgagtttccaatcagggcaagaagggtttctgacctataaaaacaatggttagctgtaaggcatatataaacttttattaaccttggacctgactcaagtaaaaattattacacttatatttactatttaatttatagaagtggcaaactggtgacctttgggcagaatcttacctatagacatgttttgaccccaaaattggaattcattgccaatactgtatttaaaattcagaattcacgagttctagttccacttgaaaatttgagagatctgggaatcctatattcacatttccatctagcaacaggactgagctaaacagtggctatcccctttaacctgggtatttgtatatttacaaacatgcttagaacactgtttcttgcattagagacaaagcagtatacaaaagtgaaaattttactgccctcacagagcttactttcaaaatgttcttcacttcaccacatccagtccttttccctggctagtctctataggtcttggcatttcctaatgtcaataaatactctgcctttctctaaaactgtcagtctccaacaggaatctcatgaagaactaatccaaacatggtgaggtatgaaatttcatttttaaaggactagatcttacacagtggcatagcagctcctttagctttcttgattttattccccaagaaataaaatcattactgctttgtaaagcatttttagtgatatatttagtaataaaaagccaggtttaagataatgctatttttctactatgtaagacaaccttatgatttacagtaagtgaaactggtaaaaggtaaaatacaaaaaaagcatactttcctctattgatcaagtttgcagtgagtgctttgtttgatatataagagaatttaggaaattctaacccagtgccctgcttttatagattaaaagaccaaaagtagtggctgacatcgggaaggaaacgtgagcccctacctcagtccttgcaccaaaattaattccagaaggatcaaagatgtaatcaaaaatttaaaaaaagaaaccaaaggataattatttttatagtcttttatgatctttgagtgggaaggacctcactagaaaagttttagtgaaagaattgctaaatttgcctacataaagaaatctctgcatgaaaaaagcatcataaagtcaaaagggtcattttccttaatatatagtattcccaaaaactattaataaaaagaccagtgagaaaagaccacaggaaagaatacaaatggcttttttttttttttttttttttttgagacagagtcttgctcttgtcacccaggctggagtgtagtggcgtgatctctactcactgcaaacctctgcctcccgggttcaagcgattctcctgcctcagcctcccaagtggctgggattacaggtgcccatcaccacacccggctaatgtttttgtatttttagtagagacagggtttcaccatgttggccaggctggttttgaactcctgacctcaagtgatccgcctgcttcggcctcctaaagtgctgggattacaggcatgagccactgcactcagccccacaaatggctgttaaacataaaaaaaaaatgaaactcataatagaaaacattttatctatatcagaataacaaagactaagaagtttgagaactattatgttgctgagatgaggaaacaggcactccaaaacatttcattgctatggagtgtccactccatagcgtagtacaacttctattgttgagaagcagttttgtttagcaggctccattaacagcaccagagcagtttctggcatatattaagcacaggttttagctagtatagttagcacatttttaaatgtgcatgtcttttggcccacctacttcacttgtaggtcttttttcacatgtgacatcaaatggtttcgtttttttcagaccaagtcttggtctgttgcccaggctggagtgcgatggcatgatcacagctcattatagcctagacatcccaggctcaagtgatccacctcagcctcctaaatagccaggaccacaggcatgcaccaccatgcccggctaatttttgtatttttggtagaaacaaggtctatgttgactagactagtctcaaactcctgggctcaagtgagcctcccacctcacactcccaaagtgctgggattataggcgtgagccaccatacccagcaagtgttctctaactaaaaatagaaaaaattagccaggcttggtggtgggcgcctgtagtcccagatacttgggaggctgtagcaggagaatggcgtgaacccgggaggcggagcttgcagtgagccgagatgtgccactgcactccagcctgggtgacagagcgaaactccgtctgaaaaaaaaaagaaaatatgtatataaaacaaaaacaaaacaaaacccataattatcctattatccttagggaactggttaaattatgatctattcaatgggataccatacagatagctatttaaaggaaaatggcagctctgttgctctggggtactgaaaacaatctccaaaataatgagatgaatacacttgtatataggaagcttctatgtaacactgtaacatatacacacatatatattttttacacctatgtctttcttaaaggatagattattgcattgttggtgttgcctcctgggacagggtagcagaatcaagaaagagtataaactattacatatccttttacattctgaactattaagatatgatctatttttaaaaagaaaacaggtttcacaaacacacttccaagtagtggctggtgtgagatctaattcttgccctcattttagttctttccaatatgttcactccttgaagtcacctggtcttgattattgagaatttggggaattttgatccacacttacaagaatatcaaacatgagccaggaaggatccatctcaaatcctgagttcattctggaggaactcttgattaaaagaatagttcttagcttagaaacttaaaagtatattttatggaaaagataatgaaagaagtcacagactcccaaaaagaaaggtgacaaggaacccaacaggtctgcctcttggatctaatttatttagaaattcttaaataaacaaacttacttactctatttcagttttagaaactcttattcgatatcctttatgcagtagttactactttaaaataacacttcgaccattaaaacactgtgaagtaggtaaagttcatactgctagcatttggtagaggtagggaactgggtctcagacataggtagtatctaaaatagattaccccaaatgttttagcatattaagtcatctaccaccaggaaacactgaaaattagttttcatcttatgataagtgaaagccccaagtctgaatgtaagatttcttatttttatgtaggccaatttatcaattctttcatggctttgggaggtctctcccactcagaatataattaatagagggcaatcataaagatgattgaagattttacttaagtccatttgttctaataccccactatttaacagagaattatcttaccgaatatgagacaaccaaagctcccatggttgggtaacagaaatcctgacttctattttaaagtttggtaggtaaccaagattgtcaaatttaactctaaaattgtcaacaaatagcttacttctataattctataagcacatagccaaccagatggccaaccttcactaataatctctaatgaaagttatcttaattcaaatacagcaactgcttccttaaacaagcatttttaaaataactgccttccccgtaaataatacaattcccaggtaagtttagtcatggaatataaccatctcaaacggcttcttagttacccataattctaaagcttaagaccaaaatgaagatatacagtaatcctcccttaccatggcttcactttcccacagtacagtattttcagaccacattcacaaaacttactagttataaatgttctcattattgctgttaatcttactgtgcctaatttataaattaaactttatcacagttgcgtatgtataggaaaaaacaaggcttcaatactcttggctctttcaggcatccactgtaggtcttacaccccacagataaggagggactactgtaactcaaaacctaatccggtattctatcttgaaacagctcaacttaatagcagaaaacttaatcttgttattgaattttgtttcagtttgtccttttagatatgaattcacattctagcccctcttcttcccattaaagagaatttttcacccaaaataaacttgttaaacaatatactgggacaggcgtggtggctcacacctgttaatcccaacactttgggaggctgaggtgggcagatcatttgaggtcagttccagaccagcctcaccaacatggtgaaaccctgtctctactaaaaatataaattagctgggcttggtggcacatggctgtagccccagctaccagggaggctgaggcagaagaatcgcttgaacccgggaggcggaggttgcagtgagctgggatcgtgccactgcactccagcctgggcaacagagtgagactccatatacatatatatgtatatatacgtatatatgtgtatatatatacatatatatatatatatatatgtatatatatatacacacacctgaggaacaatttagctaataaacagaaacgtcaagtacaaaacttaacgttctgtaaaactgcataaattcttataaagttcactgagttcaacatgtaacttttaaagaacattttgcaaatatgagcatgtttggttttaattctcaaacattttactaggtcaactgtgtctaagaactactaggcagaaataccgaaaaaaatcaacatagctctggtcttcaaatggcttttttaaagtgaaaattaacttagcatattaagacaaagacaatagaaataatatacataattttattacaaaattttttttaaaaaaacgaaatgcaacatcctaaaaaacccaaaatttactattgatactaattcctacaagtttgctgtgctaccatacacaagaaattaaaaaaaccattaaatatttaggaacattcaacatcagaagctgtaaaatctaactgtatgagtagcccatcaaaaagctacaacctgcattttttaaaagtattttctctacagagaatcttatcagctatacaaaaatctgtacagtttttatactgaagctagtattgagctgcacttgaattcacattcttagcaaaataattgcctgagcacacacacacattccacacgcatcattaaaggatagccatttattcttcatcttcatcctcttcctcctcatcttcatcttcttcttcctcctcctcctcctcatcttctggttcgttcttcttctttgagcctgttggcctgccagggcccttctttcctgcttcacttttgcccttggcacgatatgcagcaatatcctgaaatattgtcaaaaaaataaagcatccggtatcattactcaactgtgaaaaaccacttagttgtaaacaatctaagatgattgaccaataaccctaataactgtctaaaaaggtaaccagtctaagtttttagagcacttatcccactaggctttaacaagttaatgacgtaaaatgacaagggttgcgatacagcagtatcagtactttcactaccaatacccttttacatcacacacagtgccatagtccctcctgtaccttcacattttatatatatctacataaaacaatttctttgactctctgcttaaaaaaaaaaataacagactatacagactatacaataactacaagtaactacaagtctgtctgcaggaatatactagtgctacaaacactggtttcagtcaaaaggaaggtttcaattaccttgtgttgaagtgtacaattttcattaggccttttcaaaacatagctgacaaccattaatacaagattaactaaatttcccaggttttctacagttattacctatacctagtcttatccacggctttaaaaaagatgacactgtaccttttcatatttctcctttagcttagctgctttctgttcatatggttgtttatctttggctgactgctcagaccacatttcacccaatttctttgcagtatccccaatggataggccagggtgttcacttttgatctttgggcgatgttcagagcaaaacaggaagaaggcagatctgaaaggaagcaacagagtttaataaactgaaggaaaaatccaaggagcaatttgggttattttaaacttacggtggccttttaggagcattggggtcctttttcttccccttcttatcacctttgggaggaacgtaatttttcatctccctgtcatagcgagctttgtcactttttgccatatcttcaaacttcgacttctcctttgcagacatggtctgtggacataaaataagagccaaaaatacagcaaaattgttacctataaacatccaaagacgacaagatcatctttaaggaccacattttccttaacagcattttgctttcgaagtcttatataagtaaaaacctaaaatcgtctgcctggaactcttaagatattcaggtgagtcactggggtggcaaagttgaagctcatgagttgcctactacctgcctaaggccctcctagccgaaaaccacacctgcaccccctgagctccgtccctctcctgcctcaccttccatctctccgaacacttcttggagaattccgcgaaattgacggaagagtccgggtgtttcttcttgtgctcttcccggcaggtctgcacgaagaaggcgtacgaggacattttgccccgcggcttgttggggtctcctttacccatgttgacagatccgcgtccacctgacggggccgaggggggagaggggaagccggagggtcggcgcggagcccgcagctgccagggcgggcgctggcggggctccgcttcccgcccaaatccgctcccgccctgcccgcgcccccctcctcccgagggcgtcctcccaagggcggccgcccgcgcccccgcccgcgccccggcgcacaccctcctcctcctcctcctcccggcccgagcggccgcggctcagcccagcaagtggctcccggggcccgagacgccgccgcccgcccttcaccgagtccggtgactccgcaagcgccctcaaaacgcctttcctgacagaaatgtcccccagctcccacgtcgcgagcctcacttaaccgctaagcacctcgtgaccgacattgaaaactcccagaaccgggcccggtcaggggcagtttccgcctcctccgactgcccgccggccctccacagacccagccctcgccggcccgcaccccaaatgccgctcgccgggtcagaccccgagagccactgcgccgagaccgagtagaggctctgagggaatggggaaaggcaggtccacgaacccgagggtattggagggtattcttgcctggtgcgagcttttcctcagagtcccgcagagcggccggacccaacggagacgcttccctcacggggctccggcgtgaactggtttatctctaacgcaatcctcagcctcttgttttgcagagttctccgcgccacggcaacttgacgagctaggccacgggccacatccccactaatctgattggttctgacgattattcaaacccagatagtccccgcccccttgccacggaggctaacgattggtcagtgtcttaccagacccgccctccacgccccagcctagcaggttcggtgggtcgcccaggtcgttaactcccagacccgttagaaccggtcaggagaggaatgtactgctcgatcctgattggcggcgggaagagggtttgaaaaatggcgggcctcacgctgactggttggggctgtaaacggtgggagtggttggctcgggaaggaaagccccgccagatttaaaaatacttagtcgggagactgggggttggtctcctggcttggcgacggcggcggctcggtttgctggcgctaaggtaacagaagaggtctgccttgcccttcctccgaccaccatttaggtcctgtctgtcccccgcgtcggctcagccctgcagcgttggctcctgggagctgtagtcgctctgctctgttgccctgcagggtctcccgtgcgccgcccagagaataataaatgaggagagcctggagtttgccctgcaaaaccgattgcccagctcctcccgctgtcgctgaggttgtcgtagaactcggggaagtcaaggcagggaacctcggaaagggcgcggggggccgggagggaaccgttcccgcgtcccgtagggtgttaaaaaacgttctgaaagtaagatgcttcccgccgagggagtttccctcagaaggctcctccttccttccctctttgtctcgggtgacaaatactgggaggtaaacaagggcaccctccgggtcccgaaggggcggaggcggcgccttctcccccggccccgccccctcctaccgggtccggaattccaagccccgagtgtctcggcccccacgccgcaccctgcagcggtgcgccgggagctcggagccggcggctgccctgtctttggctggcctggccttcgcctgggcattcactgtctcgtcctactagtgtgatagtttttaaaaattgagaatcgcataaaagcaatgcatgctccctatcccactcccaattgcgtatattctccaaacggcatacagccacgttacaggctcctccaagcttgggttaagaacctccgtgttagtatagggagagcgcgccaaagctaccttaccttactgcttaccagcgtcacaagctgcttttcccaaggtagaggactttaattgacatcctggtgtgctatttctgtggtatttagttttgagggattccccccattattggaatataggttgcgtgactgtttcaagaaatttaaatattttgtcttaatttttcagtaagttcgttggcacatgttaagactatgctctttggtttgtatatggttgtcataatagtatttgaaaaccagcagttgtttatctaggtttactaataaaaaagatcttaaaaaaaatgtattttcctaggaaatggataatggttgtccaacattgtgaatgtacttaatgccagtgaattgtacacttaggaatgggtaaaatggtaacttttatgttatgtatgttttaccacaaaaaaataaagtggcagtttttcaaacagaaaaaaatgtatttccttttatttaagggtcccagaattttgttaatcaaaaaccttagtttataacattctcttttctgccttaagttgtaatacctacaaaattagttacaagggtgttataaaagcacccaaaaatccaaattaaccaagtaattcatagtactttattcaaatagcaattagcagtgagatcactaatgcattacacttttaaaacgtatttttaagtttctgtttagatttttttaaattatggcataaagtaagctgtgcttatataaaaactgggcctttattcaagaactgtgtattgaatatgccaagcattgagcttggcagtcgagatacaaagatgaaaagtcatagcctgtgacctcaaaaatttagagggacaaaaataggaaacagtacaacattagttaaaattgttcattaatgagagcataagacagtcacctaaagactgtgtagggaagtaggaaaactcttctatgaaagtagcatttgagtagaggtggattggagaacgtcaagcagggggaaacaaaaaacagaaaggcctttgagagagctttgcttgtttggggatcaactagtagtagttctgtattacaggaacttaatgatgatgatactcaacctgcagcttatagaggaatttagtctttatctccccagtggaaaaccggggaaaatgaaataattaggtttccacattagatagcagtgttgatggcgtggtataaatgaggtaaagttagaaatcaattcactgtgttcattcttttctatgagtccgaaactagtcagaggggcaatggtaatagatgtgagtcacttatttacattaataatctctcactacaagttaatcaactttttaatgttcactaaagttttacttcacttgaggaattttgcattatttgtataatttaataagatggtttcacaacctgctttttttaatgtcactgtaatgcaaatagtgaatttattcacatccaaaatcagagccactaactgaattttacattctattctagcacatctgttttctaagaatgattcttagatctcttttctttctattccatcacttaaactagcaattgattggatttggggtactatttttcataaaggttttttttttttttggagtgtagtggctcaacctcggctcactgcaacctctgcctccagggttcaagtgattctcctacctcagcctcctgagtagctgggatcacaggcacgtgccaccatgcccagctaatttttgtatttttagtagagatggggtttcaccacgttggccaggctggtctcaaactcctgacctcaggtgatccgcctgcctcagcctcccaaagtgctgggattataggtatgagccacggtgcttgacccagaaaggtgttttgatcacttcccagtagttgatgcctagaagaggcaaaggaccacagggtaagctaagagtagatgcttggctcacctaaggattatatgttgaattgtgttcctcccaccaactttctatgttgaagtcctgactaacatcctgtatctcggaagatgatcttacttgggaatatagtcattgcagaaataactagttaagatgagctcacactgcaatagggtgagcccctaatccagtatgactgatgtccttatcaaaaggtgaaatttggacagagacagccatagaagtaagatgatgtgaaaaagacataggaagaagatggctatgaacaagccaaggagagaggcgtggaactgatcctttccttacagcctccaaggaagcagggaaagaaccacccctgctaataccagttaccattctcttctccatgacagcagagaaaaggaaaacatttctatatttaacctacttttaccatcactgcccagactttactcctataacacacttcctgccttaaaagtaccattaagaggcacagtaaagtagtaaaagaaataaggcttagctgagatcgtattatacagtttttggttacagaacaaccccattttttgtgtgaaaaatatatacagactctggtagcacaaaaaatctagtcctaaatttaattctcaaaagagggattaaatacacacactcaaaacataaggccagttcactatactatgaattatttgccacactattatgactttatcagaaaactaaaatgtcccttaaagagttaatactaaacatctttctcattgttttaatcctgttgtggtcctaaatgtgaaataagattgtatttctaaaacagttttaaagccattttttcaagaacatatcaattgtatatattctaaaaagtccacaaatttatttctattaaaatgatacatatttctaaaacatgtatcaagatgaaacatgtatcaagatgatatagaggaaaatatttgtgtttttcattttttaaaaaatgcataaattagaacccagccagggcttgtggttttgaatggttcaattagcatttctaggccttttgaaatggagtttcactcttatttcccaggctggagtgcaatggcacgatcttggctcactgcaacctctgcctcccaggttcaagcgattctcctgcctcaggctcgaaagtagctgggattacaggcgtgcgccaccatgtccggcgaattttgtatttttagtagagacaggttggtcaggttagtctcgaacccctgacctcaggtgatccacctgcctaggcttcccaaagtgctgggattataggcatgagccaccgtgcctggtcttttctaggcctcagactgatagactataaattgaagtttacgggataatctccaaggtagaattcagctcttaaatcatgtgattctataattctgtgaatatgtgatcatagtgtgggaaaatatatattacattttaacttacgcaattgggcagtcaggaaattataattacattttaaagaataaataacttgggtcatatgaaatcccttgactataagagtgccaattaagccaggcacagtagctcacgactgtaataccagcactttgggaagctgaggcgaatggaccacctgaggttagagttcgagaccagcctggccaacatggagaaaccccgtctctactaaaaatacagaaattagacaggcatggtggcacgcgcctgtaatcccagctacttgggaggctgaggcaggagaattgcttgagccagggaggcggaggttgcagtgagccaagatcgcaccatggcactccagcctgggtgacagagcaagactctgagctcaggagtttgagaccaacctgggcaacatggcgaaaccccatctctaccaaaaatacaaaaattagccaggcatggtggcatgcgctggtcgtcccggctactcaggaggcagaggtgggaggatcgctggagtccaggaagttgagactgtagtgaaccgtgatcacaccactgcactccagcctaggtgacagagcgagactgtgtcccaaatgataaaaataaattttaaaatcaaaacagcattaggatagagttgatagcccaaatataataaactatgtagactaaactttagattacataatattgctcagtcatcctattctttcattaaaatgaccttaccagcttttttccccgccagatgatatcagtatattactttacctgccaaactttgtctgagttcagcatctcatgaattgtaaaatataaacattaggcaataaactaattatgagttagtgaagctgtttccaaagtagtcctctaacacctctaaatagctattctgttgataaactggaatttatctaaagcagtgtaatctgacaggaatgatctgtgttaatgccagttattgaaattcctagcacttatttagttttcctaaaaattggacttttcataatctgtggtcatcaaaccagactggaaaatactgatggaaagagaatatacactttttttgttaagcccttcttctgcaaagcaagaaaaaggtcttgataattcttatttattgactaactcatagccaacattaaatatactttatataaagttagttgcatataaaataattgctttcttgagttgcacaatgtaaaaaaccgaaaaccattactctgcacacaatttctcaaagataaatcttacattggagcttaatattttcaagttgttttaaaggctatgagagggaaaggatcagtatactgaagtattatcaaacaggcacatccactagtgggtagatcaccaattctgaagcctaactgtatactcaccccaaaaactcaatttactgaaataatttaacactctatctttgaagaagtgaagcacaggttaggaagaaatgaaaacctctcattctgctgctaacattttcaatgcgaaacaattaaatagtcaaagatattttgttttcctatttaaacaatatttttgtaagtcatggtaaactggccaggtgcaatagttcacacctgtaatctcagcattttgggaggccaagacaggaagattgcttgagctaaagagttccagaccggcctgggcaacatagtgagacttcctttctactgaaaaaaaaaaaaaaaatttagccaggcttggtgatgcgtgcctgcagtctgtactactgaggctgagggcaggaggattgcttgagcacaggagacaggggctgcagtgagctatgactgagccactgcactccagcctgggctacagagtgagactctgtctcaaaaataataattagaagaagcagcagcaaaatgtccacaagaaagttacttagttctaaaagcctctactacaattagaaaaaaaaatgacaagttgtaaaaatcatgttttaaaatacattggagatctgttgaagcaatcaaaaaataactcaaattaaaattccagaccggaaagagaccttcctaggtatgctgatgagttttgaaaacattctgtagattttaggcatggaactgaagtcagtctaacttggcttaggcttctagaaggactttgactaaatgaaagagactccagcaagcatttgtcagttgtattggtgggggttagcacaatcagttggaaactaaaggactctgaaatatccgtactggcctattttccacagattagctgaatgccgaggtggtatgggagactagagagttgtgccagaagcttctaaaagacaaagctaaatgtcccagggtttcacagtgtttagtggacaaaagtctagctggagggaggggtctgccacaaactcatcattgtcttttcctgaagacatttgacattttttgaaactgtttaggcaggaatgtagagacacaagttcaaaccctccaaagagcagaaatgaatttttcatagtctttcagggctaaggagacagagactgtcaatcccttaatcaaaagactgtgtgataatgtcttaatgtatgagcaaaagaaataagccacagatggaagggtcttactaaaactttgcagcctagcctggacacagctcaatctctaattggattgagataatcaatcctttaactttctccctgttagcaataggtagaatattgcaaaggtcaaaccatctctaatagaagatatcatctggaccacagcataataaaaagtattgaaaactaacaacagaaaatcttaaaaggaaccagaggaaaaaggaaaaataaattcaaaacagcaacagttaagtctaaatgctgattcttcaacagaactagggaaaccagaatcctattgaatgacatctttagatcgctgaaggaaaaaaaaaaaattgctaacctcaagttccatatccagggaaaaagctttcaagaattacagcaaaataaagatgtttcttgacaaacagaagttgagagaattccctgccaggaatcctacttaaggaaaataatctcaaatccttagaaggaggaaaaaagcataatcaagggtaattatgtaaattttaaaagagtattaccttcttaaaacagcaataataatgtcttgtggatttttataaactggacaagtagaatctatgacaacgatggcaaaaaaggtaggaagaataagtagatttaaattgacaccataagagtctctgcagttctttttttttttttctttgagacagagtctcattctgtcacccaggatgtgcagtggcgcaatcttggctcactgtaacctctgtctcccaggttcaagcaattctcctgcctcagcctcccaagtagctgggacttcaggcacgtgccactgcgccctgctaatttttgtatttttagtacagacggggtttcaccatgttggccaggatggtctcgatctcttgacctcatgatccacttgcctcagtctcccaaagtgctgggattacaggtgtgagccaccgcgcccagcctgtagttcttgaattgtaatagaaatgttcatttggcccatattcagatgaatatctgtcactttcatattaggaaatcatccttttgtaaatttttgagactgactctcactttgttgcccaggctggagtgcagtggcacaatctcagctcactgcagcctccgcctcccaggttcaagtgattctccttcctcagcctcccaagcagctgggattacaggcatgcgccacaatgcccggctgatttttgtatttttggtaaagtggggtttcaccatgttggccaggctgacctcaagtgattcacctgccttggcctcccaaagtgctaggattacgagtgtgagccatcatgccctgctgaaaataactttttatctgcttttgtgtaggtgatatattaatactatattgaccttatatcaactcaatgattgataacgacttaaaactgcaaattcttgtgtaaatactcttataaatataaaggtggcatatttacaactttgtcctctaaatcgtgttgttactgtgcttagtattttgactgtatttaaaaatatattcacaaactatgaaattttcagatatacttttcaaaatatacatctaattttaaagcctggaattctaattagactgaaaaaatgcacttacgcataattgaggattatgcatccttcaccctattcgggccactcctggagtcagggtagtagagcacagcattgcagaggccggagccagaagaaaagcaaaaatgccttccatcctcttggccttgaatctcccattaacagaactgaaccggaaagaaattggcaagtgaatctgggaaatgatatttagaattccagtactctgtaatatagagagagtaaaagaatgagaatggaactgacagacaacagaaatataaccagcacagtcaaacaactggcaagtggcagagtttatatctcaagcagtctagctcctgagtccatgcacttaactactacagtatgcagtgacactatgatatgctatagcaacattatttcatacattttaaaattaatggctgatgatgaatgcaagttggcaggaaagaaattgtaggaattggattcattaaatattccagaaagattaagtttctacgttgtgccggacactactcgaaatagaatgatgcaaaaccaaaatgaaacaaggatgaaggaagagagttcctttctcagtatttcagactggacaaaatttccctgtgaaggattccaactggcttgatttgaatcgtgtgcccccctcattaagccaggcactttcagggcaggtattaggggaaataacctagtggaaatgctcaatagaaacctgagacaaggattttgttgcaaatagtttatctaagagatgcaggaaacaccagtaggaggtggggaagcgagacaaagaagggaaaacagtcaataaagggtgcggtatcaagccagataccacttataatgactggagcataatcccatgagaaaactctgggaaaacacaggcctcaaagttatcccatctgaaggccaagtgagctggggtatctatataacaaatctttccagtcacttggtgaaggctgctagagtgggagtttgttaattcccaggcatttccaaattgccctgatcacatagggacagagctgccttccacagctttggagaaagccctcaggtcaagaaatcaatgttgaagtggtaatggccagagagacaagagcagggtctgtctcaacttcttcatcaggtaaaaattttatctgcctaatgcatggagttataaatttcaaaagaaagaacgcctatgagagagtgttataaaatataaaatgtaataccaaaaattattgtttaggagtttcttgaaggcaggaggtgcatatcatgtttttacatctctcctaaggcctagtacagtgctatgcatatgcataggctcaaatatttattggatgaatttttcaatgtaatgattattaaatattcattaaatattttctaggttaataggtgtttttaaacttataattcatatcaataactcattactgttaacttctaaaaacctttatgtttgaaaactataaagtagcatggtcttgttctatacctttgtctaaaattcttaaatctaggttgttgttcagaactctgttaattacccaaaacccattttctcctttcttcttactttaaaaaatatcttgattataaaaaaggtaatgataaattattgcgggttcaaaccaatcatgagaaagctattctcagtagcataagagaaaggcaagaaaattgtagacatcaacccggacattattgaactactgaaccattaccagtaaccatcttctctcagtcttcttatatgtcagaaaaataaactcataataatactgttagatagatattctattatatgcagccattggctaataacttttttaatagcatttttttcttcttttgcgtagcaagcccaagacaagtcatttatttctggactagattatttcattatagtaactcatcagaaaactgagataagcagtaagtatttggccattcacattttaactattttggattcccctctaactaaagaaagatcacggttttttcctacagctctctacctgtgctggctccatcaatattcagtttgacattttgacacatatctaaagaagctcaagagggctctatcaccaagaaagctgtagtgagatgatagtctttcagatacaagttaaagtcgcttgtccagttatgtatgtgatcttctgcagagccactttgcttactcaaaaaaacacatctcctgttctctcaccagaatatattttgaaaccatccacttatctccatctctactatcatcacacaagctcaagccacaatagactctgaactggtctacctgattccagggacttttgactttaacattggatcctccacagaatagccagagtgatctcaaaacatgaaacaggttaatccactttccagcataaaatctttcaatggcctccaattccacataaaatgtaatacattatcattgcatacaatgccctgcatagcctgccctcttcctatctctttgactgcatcccctaccactttcactctcactccctatactatagctatatagaactattttttagtttgtcaaacaccaaaatattttttgcctcaagactttggcacatactattgcttctgtgtttaatgctcttatcttctctctcatcgtggctggctctttcacttcaggtttaagcttaaatataaagttactatccaacttcctcttttatcaccggttataacattcatcactatctgtaattatatatatatttgttagcctattagtttagtatctgtaaccttgcctagacctccagagggtagagacatgctccttttcttctcccttaataaagcatttggtacataaatccctgtaagtttgaatcagaatgaatgaacgaattaatgaaaggcagtgattttatttgaaagcagtcttcagattccaagctggccttttttctttttttctgtctttccatgtaacagagtgatgtatgattgcagctttcatcactttggtgacctagatactcagatatttttatgatcccctcaaaattagttctaaatagatttttactgcattcctaggatgacagaaaatgggaaaaatatctaaggaattttccttgacaccaaaataagtcagagggtgggggcggaggatgaggattggtagggataccaatcatcagctagactcaggcatggtaatttgagtggtaagtaaacctgggaagcaaattagccatgaaaacaaatgcccaaagcagaagtttgaattgtaatctttacctataggcccacaaaaaggaaaggaaaccaaactggatactacattaagctgggactccttaaagaaactaaaatggtagcatactttgtctcttggcagaaacagatggaaatccttactgagggaaagcatcttactttagaaatatcacagattgatggaataaatataagtacaaaattagagatgaccaggcacgtgaagaagcaagccaccattgaacacccaaggaattcagatatttacaattgttagattcagaatacaaacatttttaataagaaaaaggatgaaattagaaagatgaggaagcaacaggtatctatcaggaatgacaaaaaagttctgaaaacaaccaaatggatctttgagaaagaaaaaaacatagttgttgaaattttaatgaatgagctacacagatgagataaagctaaaaataaaattaacatattttgctgaagaaattagactgaatcacagaagaatgagatgaacaatattttaaaaataaaacagaaacattggaaatagaataatgtttatcaatattgcaatatgtttaattagtcctagaaaaaggaaatagagaaaagcacaaagtggcactattttagtatttttgatgcatttttttcacagtgaatgatatgaattcaaatttaggaagcataaagtaacccaagtagcttaataaaaagaaatccacaataacttcaaggtgaacttgcagatgtcaaatatatatgtgtgtatgtatatatatatatatatatatatatatatatatgttttttttcttgagaaaaagtcttgctctgtcgcccagacggtaatgcagtggcaccatcttggctcactgcaacctctccctcctgagctcaagtgatttcttgtgcctcagcctccagagtagctggggttacaggtgtgcaccaccacacccaactaatttttgtatttttagtagagatggggtttcaccatgttggccaggctggtctcaaactcctgacctcaggtgatctgcccgcttaggcctcccaaagtgctgggattgcaggtgtgagccaccatgcccagcccaaaaaataattttaaaagagccacaatgcccagcccaaaaaataattttaaaagaagcaagagagaaaagaaagctcacctacaaaggaaaacagttatactgatggcagacttctcagcagcaacagtggaagctggaaaacagtggaaaaatacctataatataaagtgctgagagaaaataactgccattcttgaactgcaagactatgagcaggccaggtgtggtggctcaggtctgtaatcccagcaatctgggaggctgaggtgggaggactgcttgaggccaggggttcaagaccagcctgggaaacataatggggcactcatctctacaaaaaatacaaatgtcagctgggcatgatggaaggcacctgtagtctcatctactcatgacactgaggcagaagggtcatttgagcccaggagattgaggctgcagtgagctacgatctcatcccactgcactccagcctgagcaatagagcaagaccttgtctcagaaaagctatgtgggcaaataaaaattttaaggaaaattgagagactatcaacatactagccctaaagggactactaaattatgtacttcaggaagaaggaaaataatcctagaaagacagtatgaataaaaggaagagtgagcattattttttaaaaaggtaaacagagctgctggtataagaaaaggaaggtagataagtagaaaacagaagcacagagaaatgggaaagtgcaaactacaaaaaagaccatcagaaataaatgcaacagtgtgatttcttacattcatgtaactccagtcatagaaagtaaagagagaaaataggggaaaggtatatttgaagatataatagccaagatttatctacaactgataaaagacagttattgtaataaagaagtgtataaactaaacctaagtctcacaccttacacaaaaattaactcaaaatagataatagtcttaaatgtaaaatgtaaaactacaagacttttagacaaaacataggagaaaatctttgggatacaagcataaagaaagagttcttagacttaacatacggcaatagcatgatctatgtaaggaaaaactgaactttatctaaactaatacattttcctctgtgaaaagcattaggagtagtaaaaggcaaattacagactagaagaaaatacttgcaaaccacatatctgacaaggaactaatatctgtaatatataaagaactctcaaaactcaataaaagtccaattagaaaataaaaaaaagacatgaacaaaaacttaccatagatggtttacagatggcacataagcaaatgagatattcaacatcattagcaattaggaaaatgcaaattaaaacacaatgccatatcaccatacacctatcagattggataaaataaaaatagtgacaacaccaaatactggcaaggatgcagagaagctggatcactcatgcattgctgctgggaatgtagaatgatacagccactgtggaaaatagtttgcaatttcttaaaaacctaaacatgaaactgccccacagcccagcaattgtactcttggaaatttacctcagaaaaatgaaggactttctccaaaggtaagtagggagaaaaaaagaaagaaaaatacagacttacattttcacaaaaacctatacattaatgtttatagcagctttattcataatatccccaaactagaaacaacccagatgtccttcactgggtgaatggctaaacaaactgttctaaatccataccatactactcagcaataaaaaggaacaaattactgatacatgcaacagcctggatgaatcttcagggagttacattgagtgggggaaaaaaaaattccaggccaggcacagtggcttatgcctgtaacccaacactttgggaggctgaggcgggcaaatcatgaggtcaggagatcaagaccatcctggccaacatggtgagaccccatctctactaaaaatacaaaaattagctgggtgtggtggtgcacatctgtagtcccagctactctggaggctgaggcaggataattgcttcaacacgggaggtggagactgcagtgacctgagatcgcaccactgcactcgagcctggcgacagagcgagactccgtctcaaaaaagaaaaaaaattccaaaggttacatactatataagcccatgcctttttgtatattttgtcttgaaatgacaaaattatagaaataaagaacagcttagtggttgccaggtgttcagaaggcagtggggacgggagggagtgggtgaggcaataaaagggcaatttgagggatccttgtggtgatggaaatgttctgtatcttgactgtatcaatgtcaattcctggttatgatactgtactacagttttgcaaaatattgtcattggagaaaatggggtaaagacacagtgtctctctgtaatgcttcttacaactgtatgacaatatgcaattaagagtaaaagtttaattttaaaaactataataacaagctactggaggggggcattgaaagataaaaataatttgttaaagtgggaaagaagaaaatgaaataggacaaatagaacaaatataaaataaatgtaatgtggtagttttaacttcgaatatattgagtaagtataccaagaccaagattgtcagactggttacaaaatcaaaaacccaatcatatgctgtttaaagagatatgccataaaaatggcacagaggtgaaagaaaaaggatggaaaaaagtttatcataaaaacactaaccagagacagctgatatgacttctctaatagcagacaaagtcaaatttgtttcgataatactactaaaaacaaaaagaatatttcataaaagactcaacaaatcaagataactagaaatcctaccacctattgggaagctgaaatgggaggattggttgagtctaggagtttttaaccagcctgagcaacatagtaagatcccctcatcaaaaatgaacaaacaaaaaaagagaaatatcatagtcaatccaattgaaaattcagatgaaacagacaaatttcttgaaaacacattctgtattagttcgttcttgcattgctataaagaaatacctaagactgggatatttataaagagaagaggtttagttggctcatggttctgcaggctgtacaggaagcgtagtggcttctacttctggggaggcctcaggaagcttccaatcatagtggaaggaaaagccggagcagttgtcttatgtggcaggaacagaagcgagagagagagggaaaggggaagcgttacacacttttaaacaaccagatcttgtgagaagtcactgtcatgagaacagccaggggacggtgctaaaccattcataagaaactgcccttatgatccagtcacctcccaccaggccccacctccaacaatggggattacaattcaacatgggaattggggagggacacagatccaaaccatatcaacatcttaatgaaactgacagataaagaaatagaaaacctgaatgttcctctgtctattagcaaattgagtttgtatgtagccttcccacaaataaaattctcagcatgttttgcttcacttacaagttctatcaaatgagctgagcatgttggctcacatctgtaaatcccagcactttgggaggccaaggcgggtggatcacttgaggtcaggagctcgagaccagcctggccaacatggcaaaaccccatctctactgttaataaaaatacaaaaattagccaggcgtgctggtgtatacctgtaatcccgcctactctggaggctggggtagaaggattgctggaaccaagaggtggaggttgcagtgagccaagatggtgccactgctctccagcctgggagacagagcaagattttgtctgaaaaaaaaaaataaattctatcacatatttggaaagttcacaaactcttcaatacaaaataggaaatacaaaagaggaaatatttgaacttgttttatgaagtaagcaaaaccttggtaactagagttgcccagttaaattcgaacttcagataaataatgaataattgttagtataaaatatttcacaagatatagtaaaaattattcattatttatctttaaattcaaatttaactgggtttcccatattgttatttgctaaatctaacaactgtgttggcaacaatacttgacaaatactttacaagaaaagtaaattacaggcaggtctctgttacgaatatacatacaacaatcttgaacaaattattgataaattaaatccagcaagtttcaaaaacgatgatattatggcccatttggcattcttccagaaatgcaagattaacattcaaaaattaataaaaaggccaggcatggtggctcacacctgtaatcccagcactttgagaggccgagataggtggatcatttgagatcagaagtttgaaaccagcctggccaacatggtgaaaccacgtctctagtaaaaataaaaaaattagcctggcatggtgggatgtgcctgtagtcccagctacttgggaaactgaggcaggagaattgctttaaccagggaggcagagtttgcagtgagcttaaatcatgccactgcactccagcctgggtgacagagggagactccatctcaaaaaaataataaaataaaataaaataaaaaataaatatcaacgttattttctgtattaatggaatgaaaaaaaaaatcatccaatcatcccaagatgcagaaacatttgataaagttaaacccctatttataatttttaaaacttttagcaaagtagtaaaagggaccatcaataatttgataaaagatatatgcaaaagccctacagcaaacattgtatttaaagtgaaatgtggaagtaagttttctcctgagattgggattaggacaaggagattcaccatcacattcctattcaaacttgtattgatgtattgatggttccctccagtgtaataaagcccttctttccccccaaagtataaaaatcagaaagaaaaaaaatgtaatatgtaaaataatggcatatgtaaaatataaagtaaaataaaaaacattgtttaaaaactccaaattgctgggtagattggatgcaatcctaacataattttcagcaggtttttaaggaatgtggctgattctaaaatttgtgtataaatgcactgggccaagaaaagccaataatcttgaagagcaactaagttggaagaccagacatcaaatgttggatatcaagattatcataaaatggcaacagttaagctgtgtgatattggtgagacaacaggcatacagaccaagggaacagaaaagacacacatagaaagtcaccggatttatgacaaaagtcttagtacagtatagttgggaaaggatgatatttttaaataaatggtgctaggttaattggaaatccacacagaaaaatttgaattgaatggctacttcacaacatatacaaataacagttctaggtagatgctagtcctaaatgtaaaagacaaacactgaagtttctagaggataacagaggagaatatcttcagtatctttccaggagataaaattttcttaaacaggacacagaaagcactaagcaaaaggaaaaatgttgacgaattagactttattaaaactaagaccttctgttcatcaaaggacatgattatggatgtgcagaggccaaccccagggtgggtgaagatatttgcaatacatctatccaataaagatctcatacccagaaaacatgaggacttcctacaaatcagtaagaaaaagacatcgtttgtataaaatggtcaaaaagacttgcgcaggcattttacaaaaaggatatacaaatggccaataaacataaaaatgtgtttaataacaataatcaaagaaatataaattaaagctataatgagataccttttcacaccactaggatggataaaactttaaaaactaatataaaagttttggcaaggatcgagcgtctaactgtcatacactgctggtgaaagtctaaattgttacaaccactttggaaaatcatttgcacctactgaagctggtcatagacatatttgtgtcccagcaattctactcctaggtctatactcacagaaatgtttatgtatataaatataattcagtaaacatactggagtgtttatagcagcaatttttgtaacagctcacaagggagttggagtgaatgatcaagtaacgagttcgggaaaataaattggatatatatagtccagccatttttttttcccttttctcttaggagcaagctgccttcaggaatcacacattctgttcccttcatccatgcgttatttttcaaagttcagtgtgagtatggcctttggttgaaagattaatttctctaatcctggggtttagtattaggaagttcacttgcctgctgaataagtcaattctctattatttatttcatcagtaatagaggggatgtttattctctatatgtgatgtctttggtcttatttctcaattgcttcatattatttaatgagcttctgtatggtcataacatctggtgcattagccaaaatcatcaagaaataagacaacaaaaaggaggtggatgggagatcaaacacacagagggactgagacttttagagtcagctgtataagtagctttaaatttttatggtgcttttgtgagcacaaaccatgtgaattcttgaccttggtctttgaggcttctattctgcaacctgacagattttttacagttacacagtttgctgctgtgctgtgctgtctgtgagtgtctttaaatcttaggtcttatgaattcattcactttggtggactactaaaatttataataatagacaaatagctgtttttaaagggccctgctagccctaagcaaacatgcatgaatctcagcaaacagcctctaaaaagcagatgaggctgggcgtagtggcacacacctgtagtcccagcactttgggaggctgaggtgggaggataacttgagcccaggagtttgagaccagcctggcaacacagtaagactccatcactataaaacatttttttaaaaaattagccaggtatggtggtttgctcctgtagtcccaattacttgggaggctgaggtgggagaatcatttgagcctaggaggctgcagcgagctgtggtcatgccactgcactctagcctgggcaacagagcgagaccttgtctaaaaaaaaaaaatgctggaaaatacagatgggccttactgactggcctaagtaagcaaaacccctgcttcatagatcagactaggctccacaaacctacaaagacgtcagagaccttagtaaatagaaggcaaggaggaccttagcagacacaatcctcagagagcagacagcagcaccttagctcactcgtgtggagcccctacaaaaccaacagatttctgtagcatgtgcgagccctaattttaaaaagatacgatcataggcaaaagagacatgagaggcagatcaattatttgctgcttatactacatttttcaactaggtctacagggcaagactcatcctatacccaagtttcatgtatgttacaaagcactaatattttagctttaaattgttactgctaggcctagttggacagtgtggataagccaaatcctatccatttgtatactgtttttgtctacctataggaccaaaggaggaaactatgtaagtactgtacaaacctcttggattcatgtggattgctcacaagctcttgagggtcactccctatcaggttgattttaatttgttaatctcatatgttctgaccatggctttatctgtcatgttatactcaaatagtagcttcattcatagaagggtaatgtatttttattatcaaataatgggaattcttattataaaggctacaccctcttttggggttggaatagagaaacagcttgatgaaattactgcaatttaaatttaaagcaatttaaaatattgtgctctgaaaattggctttaggaatcaagtgtgttcaagaaatcaaggatgccataccccggtcacagcaagaccccatttccccctgacccccccaaaaaaaaaaaaaaaaaaaaaaaaatatatatatatatatatatatatatatatatatgtatgtattagccaggtgtgttggtgcacacctgtagtctcagctactcaggaagctgaagagagaggattgcttgagcccaggagttcaaggctacagtgagctattatcaccactgtactccagcttaggtgacagagcaagaccttgtctctaggctgggcacagtggctcacgcctgtaatcctaacactttgggaggctgaggtgggcagatcacaaggtcatgagttcaagaccagcctggccaatatggtgaaaccccatctctactaaaaatacaaaaattagccaggcgtggtggtgagcgcctgtagtcccagctactcgggaggctgaggcaggagaattgcttgaacccgggaggcagagatgcagtgagctgagatcgcgccagtgcactccagcctgggtgacagagcgagagtccatctcaaaaaaaaaaaaaaaaaaagaccacgtctctaaaaaaataagataaaataaaaaagaaataatatagaagctagggtggcttgaaaagtgtgcttcagtctttttttcagaacaggaataacagaataaaaacaaaataaaggttggcaggctggttgcacttgaggaagaaaaaggttttcttaagagaacatctaccttttgggaagagagcttttggaaggaaagacaagaaagatgtgaaatggaaataagatcttaaagtccaagatggacacatataaaagagaaatggagatgcacctgtgtctaaatgtcctcaaagaacgcactagaacatgggaaaatgtctttacggttattacatcagaaaaatgattgaggcccaaataaatctaacagaagaagagagacaagatttcaaggggcagattagaacagctcctcaaaaggaatcaggatctgggaaaccactgagagtttctcagggcatagattgattttgtaagggcagttaggggagctgcctcttaaaagatcggggcttgattgcaggggatttaactgttgcactttaatttttccttaggaatttgacaatgggaggtggtttgtatttaaatgtgatagatctgtgtattgttagtattttgtcattgaaatgattttatacattttattctcagaatatctttatgttttaatttgaagtcattaaagactctctgcttactatggtgtacaacatgactagatataacttgaagtaggaaatagaataattttcagccttgagcatcaagtgtccttgaaattgatccaagtaatgtcttgttttgatccatttcagagccttccggggaacagagctacaccatatactttgttcacaaaagagtggagattaggattgaggaaggagctgacttctgaaagtgggagcaaaattatcttggtcaactgctgagctcccaaagaggataaccacattctgggaggactctaggcttagtatttaagcatagtgggcttatagaagaaaatcttcagaatggcaagtagaggtggggaaattcttctttgtcttactcagtttccctacccactcctgccctaaagaagtaggattattgattggtgaatttggaaagaaaactggcattcctcttccagtctcctcctctctccttggggagttagcctgccctcccatactgcacatgttctgcttacttttgtgccacagcacaaaagagaggtggcctgtggctttccagctctccctatgatttagtggtagtctgcctattttcaaggttcattattattgcataaagaggggagctgcattccccagcatcagctttattagcaataaaggaaatgagatggttctccacctgccatactctttggtcttacataaaaattggttcgaaactcagatgaggagtgctagtactatttatatgtttccctcaaatttctaagagggtgctttcagaagaaaaggtgatcccagattagggtttgaaggacaaatagagtgtgtatggtgtaagtgaaaaacatgattgcggaaggaggaaagagcatgtgcaaaagcagagatactttaaagagtgttgtgtgatctggatggctcagtgatgtataagtaaaatgcaaggtgaggagtggtagcaaagaggctagagactatagagctagtacaaggccaatttataaagggctcagactttatcctgtagatgatggtaagcaatgcaggaagggagaggatggaagaagagtcttaagcgtgggaagtaattcaaggtaaacaagtgaaaataggtatagattagccttctaagcagcttgactattaagggaatccaagggcttatgtaaatatctagagtgcctcttagagttaagggagggtaatggcttacacacggggtttgttttaatatgggagaaacttgagcaatgtgtagcttgcaggaagagactgaaaatataggagaatgggagaataattaatggaacaaaaaacctagagagatgagaggtaatgaaatccagaaaacaaataaaaggattcctccctcttccactgaagaggcaaagatctgtgagaatgcagaccattttgttggtaggcatgaggccaccaaggaattgcggactgttagcttcaattttctttgtttaatagcaggttggtctttggtgaaaatgaggggatggttggtggaatgggaggtcagagaaagtattgaggattcaaaactagctagggatggggagaaggacctgcatgaagcactggaggagggggcagtcaactaagattggattgaactggggtaagtttcaccaggcagatgggaaggaagggcagtggggtttaatggaagagaagacatcgagagtggctgaagtgactaaacataagataggaagagaaaaataattaaagaaaattaatttctcattacatctatatcctaaagtcactgttgcagagcataagggtgacatttcttttagtcagactaaattgtaaattttaggtaccaatggcaaaaatggacataattattttgtctttttacttattagaacaatgtctttaatacacattcattcttaaaaaaaaccacacacagggaaaacaggtcttttcatggatcaaatgtatcttccatattaaagataacatggcattaaaataaatgtagcaaggattattggttttacaagaaaaattatcagaaacacacaaatagtagtccacatatctactcaatggggtctgttgtgtacaaacccaaaatataccttataaacaagcaatacttataaaatctgattacatattttgtagcaaaacttcaaaagtttccttcaaagttaggggagcaatccacaagagatcaccttcacttctgaccccaacttaagagttcagggttcccagtgagaggtgaatctgtctgggcttctgggtcaggtggggacttggagaacttttctgcctagctaaagggttgtaaatgcacaaatcagcgctctgtgtctagctaaaggtttgtaaacgcaccaatcagcactttgtaaaaaacacaccaatcaacgtctgtgtttagctaaaggttttgtaagtgcaccaatcagcactctgtaaaaacgcaccaatcagcgggacgtgggcagggccacataagggaataaaagctggccacctgagccagcagcggcaacctgcttaggtccccttccatggaagctttgttctttcgctcttgacaataaatcttgctgctgctcactctttgggtccacaccacctttatgagctgtaacactcactgcgagtgtctgtggcttcattcctgaagtcagtgagaccacgaacccaccaggaggaacgaacaactctggacgtaccacctttaagagctgtaacactcactgcaaaggtctgtggcttcactccttaagtcagcgagaccacaagcccaccggaaggaagaaactctggacacatctgaacatctgaaggaacaaactccggacacaccatctttaagaactgtaacactcaccacgagggtctgcagcttcattcttgaagtcagtgagaccaagaacccaccagaaggaataaattctggacacaccaggactacccttaagtctggtaatttacttgaaggaccgagagaactcactgataactattatattcacagttatggtttattacaacaaaagcatactggctggacacagtggctcacatctgtaattccagcactttgggaggccaaggcaggaggatcacttgaggccagcagttcaagaccagcctgggcaacatggactccatctttttaaaatttgtgtgtgcgtgtgtgtgtgtgtgtgtgtgtgtgtgtgtgtaaaagggggaaaaaaggatgctgattccaagggaattggtgcatagagcagagtccaggaaattttagtctgcagcccctctggaggtagactggctatctcatggcccaaagaccacatcataaatcacattcttacaccatccagtgtagctaaaggctcccaggtaaacaaagccactcttcctagagatcacctcctaggatacaaggacaaaggccagacttctttttgggtaaggttaattctttgctacgcacttctaaaataccaaaataatcaattctctgaatatattcctataaaagtaggtattaataacctattgtctgactccctgctgagtcaaatatattacttttcatgattttacttcatacctgtgattgcttccttaagtttttcaaattcacgttggaatgttgagttataaatttcatttgttttatgacaaccattttctggtaaattttcatcttctgcaggaaaatcgtgctactccgtttcacagtttttttattataattttgaatagatgttctgcatatgactttcataatctttgaatttaaattagtgaaattttcctggactactaacaggaggtgaaaagaaagattaggatagcattataaaattcatctctcgagggctccctcttctgttgctatagaagacgactcttttcttaaactctgtgaacacctactctgcctctcagaactgaacctggttccaaagagcttctacacacagtcctgggcttcctgatttattcacaggctgcagggacacagatattgccttctaagatgatgatactgcttttagaagttattttactggtgctttctaaggtctgcaatctctgattgggcagcttctgtccttctctctctcccttcccaatgtttggagcctattcagtcgcagccttgtttttagggtacagccaccactaaactccttccccacttccagtactttcccatattgtcttgatttcctatgtgggcttgctgtcctcagttgcctattgcagcattcacatttaattttggagttttggagttttcttagctatttgctgaaagttcagtttctatgaatttattttcattttcttggttgctctggatagatttcaggagaagaaatgaaaactttcaaaactaagcagacctcatattcttttagaatgctaatataattcatttctgttccatgttttcaaaaaatatgaagaaattctagggaagtactctgattattggcttcagataatgaagaagaatgttatagttgtcagtagcccacttagagtcagttatgtagatgttcccatctgcaatgacaccaaggctataactatagaaggtaatatcccaaagcagtttttatataaagtcatttgcagcatatagtgtagatttttttctttaattaaaatgaaagcacctcagtgaggtgctttcaacgttttattctggtatactaaaaagaagattgttagtcaaaatgtttctcctgaacccaagtaactggaacactgtacagaagtgtttgagaacgtattccaatctaggtggattatgggtgagagaatgctataataattctcattttagttctggagattttaatctacgttcagtttctttttaaaaattactaacattctattttgctagtcagtcacaaataattttgtacccagagcaagttccagcattacctgggaactacatctccatcttttttatgcctcactctctcatgagaacaaaatcaaggtaaaagccacagagatatgctgagcaaaatgttaagactatgaatagtatcagaatgcagatgttattttactatatactgtactagttataaccaagtgacttaaaataggaagtaagaggaagagctgagcgtgtggcagtcactttgatgtagggttggaatccagtataccttgatggtggtaaccctagtgaaacacctcctactctgggatagaaccctgggaagcctaggccaaaagtggggagagggactagaatgatctggttggctcagaaatcctcaagcattgattcaggactactggcaccctttagcacccaatggaaggaaaagaagcgcctctctataggaacattacatcatccagtgcttcaaattgtttatattaaatcagtttttccaattaaatgaactgcaaacaatcaaaattaatggatgcaggaagagtaagcatgagacagccaccaggagaaacaatagacaaaagaaacagacttaataacaaagtctaaaaactactatgcttactatgttcatgaaagaaaaagtcaagcatataaattttgtccaggaactagaaatcataaaaaagtgacattcaaggttttaaaaagaaccagataggaattataaaactaaaaaatgtaataactaaaagtacaaagactacgggtgaattttagagcaggttagggacacctaaagagataatgagtgactggaagataagttaaaagaaaccctcaataaattttaaaggatttaaatcatacagagttctaaagtgacaatttatatgtgttcgaaatcaataagaaaaggataatcacattatttgcatatgtttggaaataagaaacctacttctaggctgggtgccatggttcacacctgtaatgccaacactttgggaggctggcagatggcttgggtccaggagttggagaccagcccgagcaacatggagaaaccttgtctctataaaaaacacacaaaaaacaaattagctgagcatggtagtctgcacttgtagtcccagctatttgggaggctgaggtgggagaatcacctgagcctggggaggttgacgctgtcatgagtagtgatagagccactgcactcttgcctgggcaacagagtgagactctatttcaaaaaaaaaaaaaagaaaaaagaaaaaaaaagaaacatacttctaaatctatgcatcaaaaaaatgataggaaaattagatgatgttttaaattcaatggtaataatacatatcaagacttgtgtgatgcagttaaaacaatattgatggagaaatctgtagcttttaatgtacatatttgtaaagaagttagtaaaagaacagcaaaatagaaagtagaaagaaataataaagaaaatagaataattgaaatagaaaaaaatacaataaaaactatgtacaaaattcaggtcctctgaaaagcctaataaaattgatagaacactggtgagactgattaacaaaagagagaaggcactaataattgatgatgaagatagggacactgggtcagatcttgcacaccttaaaaacatgaggttgttatgaacatataaatggtataaaaatttagatgaaaaacaaaaaaatctgtatcagacatgatacataatagcgaaacatgaaaagcctttcttttgaaactggaaatgagacatttttgcctgctaacacctcttttataatgttgttctagagtcctgaacctgtagtagcacaagaaaaaagggaataaaaaatgaaggaaaactcaacgatttgaaaatggtatgattgaatgcattgaaacccaaacacaaatacatttatatttttattggataagaaattttagcagggttgctggatataaaaattagtttggaaaattagcttattttatatatatttaagcaacaaaaaaggaaaatgaaatattaaaaagatactatttacaatagtgtcagaaatatcaaatatatatagagatataataaaagatcagtgaaacttctgcatagcaacaaatacaattatattaagaaacattacagaagacctaaatgaattgaaaatcatgattggaaggctcaatgttgaagaagtcgctcgtctctcaggttaatgtatggatttgatgcaatatcatccaaaatcccaaaaggccttttttgttgttgttgttgttgtcttattgttcatttggttggtttttcttttttctggaacttaagctgattctaaaatgtataaggaaatacaaagggtcaagaataaccaagtctgtgttttgacgaaaaaaaaataaggtagaagatctatacttctaggttatcaaaatttttctgaacgacttttataattaagactgtggaattggcaaagtacaatggaaagactaggcttcagaaacagacctacatacatacaacttgatttatgacaaaggtgacactgtaaaagaatggaatatggatagattttccagtgaatggtacttggtcaaatgggtagcatatacaaaataaaattgtacctcaaccactgtgcacaaaaatcaatcataatcttaaatgagaaaggcaatacaatgaagctgttagaagataatgtagaaaaatatcttcatgatttggggataaggaacttacttaagtcacaaaaatcatcagtcagaaaagaaaagatagatatattttttcctcattaaaagactttaaacaaaagttgccactgcagagtcaaaaggcaaattatgaagtaggcaaagatgtgtgcaatatgtaaaattgtgaaaaggctgttattcagaaaacatgaataactactacaaatcaacagaaaaagacacaatcccaatagaaaaataggcaaaagacctaactaggaacttccaaacgagaaatccaaaagaccaattaatatataatctcattagtaactaagaatgttcaaattaaaatcacaattagataccatacatacctacttgatcttttttagaaagtacaatatcaaatggtaggcaaagatacagaactctcatatattgcttaaggaagtgtaaaagtttggaaatatctagtaaagttgaatctacgcctaccttaaaactcagcaattctgtttacatatgtaagcaaggagctggaagttctcactccaacttaacaacatatatatcttactgacctgcagtcacgtatgtatcaggatacatgtacaagaataagaatgttcatggcaacattcttttaatagccctaaacgggaaacaatccatatgtctatcaacaatagaatggatatattgtagtttattcataccataatgaagagaaagaattaaactacataaaagtagacctttgaaaaacagagtaaatgaacccaaagaaaacagaatataaagtatatgagtccacttatataaagttcaaaaacagcaaaactgaaaaaaaaagttgaagaactatgtggcaaaactgtaatgaaaaacgaggtaacaaataccataaaagtcaagatagctactcctgctagctgggagatgggatttatgatgaagaagtggcaggtgatggctttctggcatgttgtcaatcagggccatctacataatttgtggtgtccagaacaaacatcttttttctctccctccctctctttctcctcacatggtgttttcttatttgctatttaatgtggcactcccttgggcacaggtggaaaactgacccaaaggagctaggggcctgactcctggttcagaggaaatggggaggatcctgcacctcagccagacacttcctgcaccgtacctcctgctcagcctctgccagagcagagggtggggtggggtggagtggagagagtgagcagccagaactcattctggggaggaagggaggtggcaggaggcccatgttgcctgaatcaatgcattgtcccattgatacttcactgataaaacacaaattcaaagataaaattattgagaattacatgatggtgattgcagggcattaaatgtcaagcaggaaggaggaggagagtggagcatgttggcttctgagcttggggtcctgtgccactgcaagtccctgaagctggccctttcagcaatgttctctttcctgacctgggtagcagttatacggatgtgcattttaccataactgcttgtctccgttcatttgtgccgccataacaaaatagttgagactcagtaatttataaaaaccagaaatttattttctcaaggttctggaggctgagaagttcaagatcaagatttgatcttggtgtctggtggaggctgctctgtgcttccaagatggtgcctcttgctgcatcctcacatggtggaagagatggaaggggtaaactcgccccctctatccctttcataaggcgctaatcacattcatgagggtggcctcaccacctcctaaaagccccacctcttagtactgttgcattggggattgagtttcacaatgaatttgggaggggacacacacaaacactgaaaccacagcactgcttaaactggacattcatgctttatacaattttctgtatgatggctgagtttaaaactagataaaggaaaggtggtgtaaaacggaatgaacttttgctgtaaaatatagaattattcacatatagagatgtatatactagtaaatgcatacttttttctagaaggaaacaataatctgttaacactggttgcttcaagggacagggatttgaggagatgaggtaaaacaggcttttgtttttcatatgaacctttttgtattatttgaattttctactgtggtcatgttgggattattggccaatttatatgtttttgtaaattaaataaaattatttagttgcttattttaaagtaaagccagaaaaatgcaatcatgttaaaagcctatagggaagacaggcacggatacatacttttttaagaatcatattttgaaccattttagaaagcaaagagcatttttgttgatatgaacaacccccctataattaaggtttcatagatctatattttttacctagtctactctgaggtagatttactgtgaagctaaaggattcaaacttcagagtccctcacttggatagacccttatgaagtcctgtacctaattttaattttgcattcataattttacatacttctttaaaaagacctttcagattatataatcttgaagcccccctaaaacctgattccaaccttgactgtgagttacactcaaatcaaagagttcttatacctgccctaaatatgaagatttgtagaaataagtaacaaaacatggttgtaaaaatgtatctaaacaaatagattcactcaagatacactttaaatctggcagtgagaattaacatgtcccctactccagcaatcttttcaacttgccagaaatgaatcatttcctcctatgtgctatgcctgtactttctctctattgttattgaggtttgtattatgtgcttgttaagctacctgtctgccctactagacaagaagctcccaaatagctaggaccctctcaattatttttgtgcctccagggcctagaaaaagattctagcatgcaacaagtgactgtttaataggatctttttacaaccattgtattgtgtgtaaaggagccatagctacagttctttacttgagtaagcttcatatgaaactgataactatacatatacatacatgcacagcttaaggagattcacaaagtacttatcagtaagcatctttctttttcctactgaatttacatgatttggtcacattttgcagaagatataagcttttttaagcacaagaaccaaacaatatgaatttcatgaactattttaaaaacacataaatgtacaaagaaaaatatgaaaattcaacatcccactgtcatgtttcagatatttttaataaataaaaactttaaaattcagaagaaaccatctttaagccattcccagtgtgaaaattgatcatacaatctggatcattcttgtcatacccaactaaatcagaatcgagggaccaggggagaaagcaatcagggcacacagctctagcattaagaattaagttttttacaacccagctgctgaaacggcctgcagtaactctaagaccagttttaccgagtagttgctgaaacaatctcctatgactaagactggttttatctaccactctcactcaccaatcagagcttgccagcttcccaaaactttactatagtgccaatgaaccttctttcaaaacagtagcaacatttctctttctaataaaactctcgaccttctctttgttcttctgacatactaaagaccactcagtctgtgtgtatgtcctgaactgcaattcttgcttccccaaaaaaccattaaatttagaaattcatctctttatattttatgtttactctgacaccatatacaaattccttggcctccttcgttggagatgagcatcaccctgaagttgggatgtatcatcccatccatatattctcatttttaccacttaagaaaatgtatccataaatatataacatgtatccataaatatataattattctgtgttgtaatttttttttttttttgagacagggtctcgctctgttgctcaggctggagtgcagtggtgcaatctcaggtcactgcaacctctgcctcctgggttcaagcaattctcctccctcagcctcccaagtagctggaaccccaggcttgtgtcaccatgcctgcctaatttttgtatttttaatagagacggagtttcaccatgttggccaggctggtctcgaactcctgacttcagatgatccaccctcctcggcctcccaaagtgctgggattacaggcgtgagccaccacgccctactgtgttgtaatactttaagccagtgttatctaatgcaacaggtacaatttattgtaatattttgtttaacccattacatccaaaacatttaaacatatataaaaatttttaatgtgcacttcaatattctttttgaaaatttcttgtagtaagtccagaaataaaaaaaaagtccagctgatatatacttacagcacatctcaattcatatgctaaagttagagttcataaaatttaagttggaaaaacagattcatatatctgagttgttgcaaacacacttaaaagtattccaacaattgaatcgagcatcaggtttttggtttttgtttaattcaaattcaattaacgattcagtttttccgtctcaaccacatttcaagtgctgagtagccacatatggctagaggacagcctactggacagcacagcttaaggaggtacacaatgtacttatcagtcatcatctttctttttcctactgaatttacgtaatatttaaattgtttttctttgtcatatcctagaactcaaacgcacagatacaatggatacctttgattttctgcgtcgatggcattttgcatttaaaaagatcatctgggtggggtggcgcgcgtctgtaatcccagctactcgggaggctgaggcaggagaatcgcttgaactcgagaggcggaggttgcaggatcgcgccactgcactgcactccatcctgggcgacagagcaaactgtctcaaaagaaaaaaaaatcatttatcactaaatttactcaccaaaagaacttgcaaaaaaaaaacccaaaaccctactgcctaaaatatattttaaaacgtatttgtgtttaagcagcatatatcttttgataaataatgacgcatggtagctaactagtaaagatgcagctttcatattagccacgcccatccctctctccgccctccacaagcacgtccccgcaagcgcgcaggaacatacacgcgtacgcgcgcacacacacgtacacacgcgcgcgcccgcgaacacatacatacaagcaggcgcgcccaaacgccggcagcacacaggcgcgcacgcgcttttcaggactcaggaaatgcgctttctgctccccgcgcccggtagagctaatgcagggaagtttctgggaacattcgaccagcgtttgtattggtgaggttccaagtttcctttaaaatgatatgactccgcccttctccaaaaccgtttgaggagaaatggaaaaggttgggcgtggaggtgaaaaggagccctgttgtcaactggtccgtactccacctcaggaggcggccaacttggtgcgcccaagaataaaaacatttcccttgtaagaacatgcaagtgtttagaaacgcccccccacccccccgcaaggcgtttgtgagggggacctgtcacagttgagaagtcaggatgggcgttttcctcccaggaggtgccctattaatttgcggcctcgatagttggtcaagccgggatgttagctgcggaacctccaggaccgaagagcgccaattctcctgagttctccttggtttgggtttcccacaaaagagtggtcacaccaaaaactctgtctccacaaatgcgaaacgggctcgaaacttttttttccccacacgatcacttcccacaccactcccatccctttatgtttcgcctcaggagtcgaggaacttctctgaaaaccaattctacgatattccagcagctaaacacagcccgaattccctagaaacagagagagcgagagaaaacactgtaaaccccaatcacacgctcctgttttcccggtactgaaaaaaaaaaaaaaaaaaaaaagtgggtccgtggccgcgctatgcatgctaggattagtagttcctccgtccctcatggcgcggggtcagggcggagctcaggttgactctgcagcagagaactacaattcccatggggccgcgcggcagaaagaaaggggcgggacgggagggggcgcgtcgcgcttgcgcaggtcccggggccggagggaggcggaggcgtagcggtccaactgctgaagtccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgtaagtaaaccgcgggaccgccctgccctcccgcccctcggtggggccccaggagccgggcaaaggcacgggttgtcggcggggtcccccagacaaccgcactggctgcagtgcggtctcgtggagtctgtgtttggaagcaaataacaaagtcgctgcaactcctaccgccaccccaacacacacaccacacacaggctgtcgttcccctcttctttcccaccctggcccccaacctcccgctgcctgcgtctctcccgcgcagtcttccctcttccttctcctctgcgaccgggacacgaaacaaaggggaccggcgcactgagggcccagagtagttttcttgcagcccggcagctcttctggaatggaggcgcctttgttttgctgcccaagctggtgtttggccccaggcggtactaaatcccgtcgtctaggagaaagcggaggaccttcacgaacaaggaagatcctgttcttttctgtgttccgtctcctccggagcggagtgagagggaagccgagctcacccgccgcctggcagtgagccggggttgtaaacggcgtttgcgctgtcagctccgagggcagctactccgatggtggggagcacgtagcctctgcggttttgccatccccttggcagccatcaggattttttgcacgtcttttcgtttgaccatctatgaggtttttagaaacagccgttgctacttttgggagatctggctagcggtaaatgaataacatggtatcgagaacctaccacaagtcctgcatatttttatcttgcgcttggcttagaagtaaatgtaaaagcctgttagctcagtccgtgtttgtttcaaatgctagtctacagctcgcaggagtatatgtaattaaagtttttgaaaagtttatttgtgacactttttgcccgtttaaacagttttcagtgttatccatgagaaactcttcaggtgaacttgcataatttcagattgttttggaaaaatgtgttatagataaatacattgatttaatattcagaaaaatgtataactgaaatttaaatatagttttgaagtcgatggctcatttgtgaaaacgaatggttttgtatctggactataatttgggtattcagttagaaagactggaaagcatacattatattactaaaatatgctgttcttttaagtagagaaagtactgtcaagtagcaaaactgtgagcaacatcatctttcccctcatcagttaaaaattcaacatgaactaattcaggtcatccttactgctatctgtttgtttatttatttaagacaaagtctcactctgttgcccaggctggagtgcagtggcgcgatctcggctcactgcaacctccaaccaccaggttcaagtgattctcctgccatagcctcctgagtagctgggattacaggctactgccaccatgcccgcctaattttttgtatttttagtagagacgggatttcactatgttggccaggcttgtgtggaactcctgagctcaagtgatccacccgccttggcctcccaaagtgctgggattacaggcgtgaaccaccgcgcccagcccctcactgcaatttgatgacaaaacccagagggttggaatttctcattctcctctccctccctcccttacccccttccccagatggaaccaacccctccttccccatccaccatccttttaacagtattccagacatcttatgttttagcgtataggatttaaacgtataaatattccattatcttaacaatggcccatcttggctgtctttatttttaagaactcactgtggcatatgtgttttactaatacatagacacattttactgtaatcataagcagtgtgtaaaacttttctgtttcaggcaaggcatctttacatatgtgattatcataaaaacttaattcagagtgttcgaaacagaagaaagagaaaagggagtgatgatgatggaggtgattcacctgttcaagatattgataccccagaggtagatggaagttttttatgcttaatgtaaatcctaagtagtgcattctgaagcctttataaaaagatatgaacaatcttttaagtgtttaaaacatttgagaaatctgaaaatgaaagcaaaattaaatatagccagttgacatgcatttacacagtttgaattgttacattttagattgacaatttttgcagctctgttgtcacataacttactctttttttgacctcagtttatattatttatccccaaaagattaaattctttaataatttatgttggattatataaattttttaaattttttttgattttggaagtaaattttattgtgctgaagttaaaatgtttgttattatacatatcaatgataaattttcaacaaattgtatgaactcatttatacatgttaattttttctaggttgatttataccaattacaagtaaatacacttaggagatacaaaagacacttcaagctaccaaccagaccaggacttaataaagcacaacttgttgaggtatatatgagttttaaactatttgaactatctgcacaaccgagaggttattaagtgctaatggaagttttaatgtagtgtatgtaacagtacattttaattagaaagaacaaagttaaaaaatctgttgtggaagaatctagttgtgtagaaatgtttgtctgccacttaggaaattcctttttgtaatgactgcttagtagattgtgtacagcaccttctgatactggctttcaaaatgtgttgattgttttttgagacagaatctcactctgtcacccaggctggagtgcagtggcatgatcttggctcattgaaacctctacctaccaggttcaagcaattctccagcctcagcctcccaagtacctgggacttcaggtgtgcaccaccacaccaggctaatttttgtataatatttttagtagagatagggtttcaccatgttggccagacttgtttcaaactcctgacttcaagtgatctgcccacctcagcctaccagagtgctgggattaccagtgtgagccaccgtgcctggccctcaaaatgttgaatgagagtttttttaatcctcactttagaaatctattaattttaaaactccgtttaaccagtaaacatttgagcacctaattgaggcataataaaattaattaacaagctttaatgtccttattagaatttatattttaaagtggtggaataggcctacaaatcagaccctaaacagtatttttataatttgctgacttaactatttcaaaatttgtccttgttgatgtttgttttattagagacatccatgtttttttcacatctagaagaggcaaaagcttttcttttacccaagcttttacttgtagtttgctttgatagaggacttctagtcagtcactgagttgtgaaaagttaacggagcatgcatatgttttcaggatataatagaaccaagaaatctgtgcatcttattaagatgtttatagatttatatatatatattttaatcatatttaaaataaaaatttttacttgcagctactgaggaggattgattaagcctaggagtttgagtcaccatgggcaacatagcaacactccatctctaaaaaaagaaaatttggcctactagacaaaatagaagtgtagaaatataaatcagttttctcatattctttgcatggatttagtagttacccaacattttctaaaatgtgcctattgaataaaatgaaatatgaatagaagttacatttatttggcagaatgctttttaacattgttaaaatctaatatattaactatttagctaaaattttttatccttggttgggcaacacagatctaattaatttttctttaattttgatttaaaagatcaagttcttttggggttgtacaatacattaatgtaacataaatatagttattgcccaccatgatgaaatatttcaataggtactaatggagtgaaggcacccctgttttgggacaaatgagaaccaaagaactgattattttaaatgttatatttaggtataaattaaacctgtaatttttgataaactgaccttctaagaacagttatattatttccagagctattttcttttttatacataagagatagccatgagtgttatattttacttaatcagaaatgcagatattagcaagttaaggaatgtgcagatgtagtacatatattttaagagaggggtccccaaccccagggccatggactggtactggttggtggcctgttaggaacgggtccgcagagcaggaggtgagcaccagctagcaagcattactgcctgagctccgcctcctgtcagatcagccacagaattagattctcagaggagtccaaaccctcttgtgaagtgcacatgtgagggatctagattgtatgcttgttataagaatctaatgcctgatgatctgaggtggaacaatttcataccaaaaccaactccgccaccctcaatctgtgcaaaaattgccttccgtgaaatctatctctggtgccaaaaaggttggggaccactgttttaagggaatccagggttgtatgactaagtcttaagtctcttaattattgtgtggatgaacttttttcttaagaaattttattttctggaatctaaatatgcatgtcagcaccccaggtaagtctattattcttctattagtaattgtagtatgcatgttatgttagcacaatgaaaaagcaaggaagcaggtaaacatccttcattgaacatccctctttctcctctcatttccattcataatttttattcagaaaaattttcaaggaaccttaaccaaagaatgctaccaaggtgtgaatgaatgaatataatttgcagcaaacaatttatatgttattgttggtttctctactagcaaaagttttcaacttcatacttctttttctatcagtagagtctaaaccattgcaggtttaatgatgcatgtgatctcttacgtctgttttatctcatttaaagtttaaaagtaaaatcatttattccctattctagattctaattataaaatttattatttttattttatttatttatctttttttgagacagagtcttgctctgttgcccaggctgaagtccagtggcatgatctcagctcactgcaacctccaccttctgggttcaagcaatcctcctgtctaagccttctgagtagctaggattacaggtgtacaccaccaggcctatctaatttttgtattttttttggtagagatggggtttcgtcatgttgctcaggctggtctcaaactcctgggctcaagtgatccacccacctctgcctcccaaagtgctgggattacaggcatgagccaccacgcctggcccaattataaaatttaaaataaataaaaggaaaatatattttctaatcaatgtatattaaattgagtgggtcaaagggtcctttgaaatcacactatctcttgttcgtaacattttattcttgaatgctttctgtcttgttgatattttgttaaatataatttttaaaggaaatagcccttatcacatagcactttttcttttgatgaaaccgtattttttacgtagtttatgaaacctgttatatctaaaatttaatttccttaatttttcttttctttgtagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaagtgctttatagggctagcaaatttgaaaaataaacttctcttggaatgcaacttcttttttatttccttttttttgttattattacttgatgaagtactaggaagaacaaatggtttaatttatatacccacctccttccaaagaagacttaatgtgccagcaaagataaacacaatgctgaaagttgaaataagagtataaaattaaatagctgtttttcaaaattttgtcttcgagaaaagatatttatgtggcatgaatatagaaagtacctctgctatgccccttaatttttagtgatgtcctgtactgtttacattgcaaattgtaactaataagttggagaggtctagatatctatccagatcttcatttaaattttggttatatatggctctgacttgatttatatctcctttttatgtttcattctctgtcagttttctatcaaacattctaaatctctgcttttcttgagattatattgtttagctaaattcttataattacaaatcaaatttatagcttgtgacataaaaaaacgagcttcagcaaactgttctgagataaagctgcagattttaggctggaaatggatgagaccattaatgtagctcatgatttctcaaagttgacatttggacttgttaattctttttttgtgtgaggccgttcagtctattggaggattagcaacatccctaagtccactcagtaggtgccagtagctcccccaaggtgtgacaaccaaaagttcctctagacactgccaaacatactttgagggtcaaaaatcacagctagttgagaaccactgatgcaactaaagtactacatctaaagtactagttcattagtaggtgactgtgcatattttcaagtgttcttaatgtattgacagctagaaaatataatgaaaaataaagcaactggtcgttggttttgctatgaccatttaaagatttacttgctactttattgacaagcagagtctgtgataattgctattatagaaacttctcatttccgacattctggaaatctgtgagaagatttcttatagaaacacattttgaggccgggtacagtggctcacacctgtaatcccagcactttaggagaccaaggtgggcagatcgcttgagcccaggcattcaaggccactgttggcagaatggcgaaaccctatctccacaaaaaaatacaaaaattagataggcgtggtggcatgcatctatagtcccagctacttgggaggctgaggtgggaaaatcacttgagcctgggagacgggctgcagtgagccacgattgcagcaccgcactccagcctgggcgttggagtgagaccctgactcaaaaaacaaaagcaaaaacaaaacagaaaacaaaacaagacccatattctgttcttgtgaaaaaaaaaaacaacttgaaattatttgctgacataaaagtatgaacataacctttgactggcaatgtttatttcatataattatttgtataataaaatgtagttttataaaatatgaatgaagagttctggatggtagttattaaatgaaatcaaatccttgttaaaacaatttaaaatatgaaaaatcagttcttgtaagttgagaacttccagaacctcaccaaagctgagtaactcaagaagctgcaatgtaaaagtcagttttatgtgaaaatttcagttaccattggattttttaaatgatggattcattagaaactatttttacttatctatatctgaacaaaaaatgaatggaaactcatttctgtaagggtataggttacttttgatgttagagcattaagagaagaatctaaatttaaatgccactagaagtaggagaaaaagcatactgaatggatagcaggggctcaaaaaataagttagttatttgattactagcttcaaaagaataattttgggaaaggcctaaaaattaatgcctgaaatacatgtctttacaaaaaataaattctatgtttttctacatgaagtcttaaaattaagaaacataataaaatatacaattaatcattttaaagtatacaatatggtggtattcaatgtatttgcaatactgtataaccagcagctctaatttcaaaactttcttgtcacccaacaaaaacagccatacatagtcactccgccttcttccctctccctattccctggtaacctccattctgctttttatctctatggatttgcctattctggatatattataagggaatcatacaatgaagtactgcaaattggatgaaccttgaaaacatgccaaaaagcataatgctaaaaaagcatgttttcaaggttcatccaagttgcagtacttcctttttcaggctgaatagtattccattgtatctattgaacacagtttatttatccatttatttgttgatgaacattgggtttctacctttggctattatgaataatgctgctgtaaacattcatgtacgagtttttctgtgaacatatgttttcatttctcttgggtgtatacctagcagtagaactgctggtacgtaaataattctgtacttaactttttgaggaacttccaatcttttccaagttgctatactcttttacatttctaccagcaatgtataaaggcttctattcaattcactaacacttgtatttcattaaaaaaaaaattaaagccatcctactgggtgtgaagtggtatctcattgtggattttatttatatttccttaatgatcaattttgttgaatatcttttcatgtgctcttggccacttatatatcttctttggagaagtgtttattcaagtcctttttattctttttttttagttgggttgttttttgttgttgaaatgtaggactgtttatttattgtgagtattaaacccttataagatacatgatttgtaaatattttctctcattctgtaagttgccttttcacagtactgataatgtcctttgatgcacaaaagtttaaatttttacatagtccaatttatctattttttcctttgttgctcatatttttggtgtcaaaagaatccattgccaaaaccaacatcataaacattaatgtatatgttttctaggagttctacagttttaactcctaaatttagattgttgaactgttgtgaatcaatttttatacatgaatgaggtaggggtccaacttcattcttttgcatgtgattagccacttgtccagtgtgatttgttgaagaaactattttttcccaactgaatagtcttgaccctcttgaaatcagttggccatagatgtttatttctgcactctcaattctattccatgatctatgtatttattcttatgccaatactatactcttgactactgtagacttgtaataagttttgaaatcaggaagtaggagtccttctactttgtttttctttttcagtattgttttggctgttcagagccccttgctgttccatatgaatttgaagattggtttttttcattttttgcccaaaaggctattagaattttggtggagattgcattgaatctatggaccattttcagattgccagcttaacaatattaagcattccaatccatgattgtgggatatctttccatttttttaggtcttctttaatttctgcagtgttttatagtttccagtgtacaagtctttcacctcttggttaaatttatgtttatgtattttcttctttttgacactattataattgttttcttaaattcttttttgaatcattcattagaggtgtgtgctgatgctgccactgtgctgaattgatcagctctagtaattttttttgtgtgtgtgtggattccatgggatttttctatatatagaatcatgttatctgcaaacaaaaatggttttacttcttccttcccaatttggatgccttttatttcttttccttgccaaattgccctggctacgatttccagtacaatgttaaacagtagtggtgaaagcaggaattgttgtcttgttccttttctcaggaggaaaactttcagtctgaccattcagtgtgatgttagctgtgggttttcataaatgttctttgtcatgttaaggaagtcctcttctgttgctaatttgctaaatgtttttttatcatgaaagggtgttgaatttagtcaaatacttttagtattgagatgatttttttttccttagtagtattgagatgactttttttttttttagtgtatattacattgaccttcttatgttgaaccaccctcgcatttctgggataaatcccacttggtcatagtgcataatttttttaatgttctgtgggatttggcttgttaatattttgttgacggtgtttgcatctatactcataagggatattggtctatatttttcttatggtatctttatctgactttggtatcaggataatgctggcctcatagaacgtgttaggaagtattctttcctcttctatttttggagatttttgagtaagaatgatattaattcatctttaaatgtttgacagaacttatgggtgaacctatatggtctaggctatttcttcgatggaagagttttgacggatttaatctttttacttatataggtctttttgttatatataggtctgttgagactttgtgtttcttttaagttatttttggtaagtcatggaatttgtctatttcacctagattatctaacttgttgtcatacgaattgttcctataattctcttataatacttttaatttctgtaaggtcagcagtaatatccctacctttatttctgattctacttatttatgtcttctctcttttttcttagtagtctagctaaggatttatcaattttgttggtattttctttgatctcatggattatatttttttctctatttcatttttctcttttcggatcttcattatcttctgctggctttggatttagtttgctcttctttgtctgttttcttaatgtgtaaatttaggttgatttgatatttttcttttttaatgcaggcatttacagctgtaaatttttctctgaatacagtttttcctgcattttgtaagttttggaatgtttgtttttgttttcagtcatcttaaattattatctaatttctctagtgatttattctttaaaccactaaagaaaattcacaaatacctggaactaagcaatatacttgttgtgaagcaatatactttttgtgaacaagtatattgcttagttccaggtgtttgtgaattttctagttttccttctgtattgattactcattttattgtggttcaaaaagatagtatgtatcaccttagtctttttaagcttatagataattgttttatggaagaacatatagtctatcctgaagaatgtcccatgtgtacttgagaagactgtattctgctattgttgagtggaatgttctgtacgtgtctctggggtctagttggttttgtagtattgttcaagcctcctacttccttattggttttctttctacttgtctatcaattgtggaaagtgaggcattaaggtctccaactattattgtagaactgtatatttctcccttcagttttctaaaggtttgttttatatattttctggctgtcatatggtgcatatatgtttataattgttatatctttttgataaattgaaacttaacaacataaaatgtccatctttgctcttgtaacatgtttttacttaacatctaatttgtctgttattagtatagccatcccagcttttttttgtttataatttgcacatatttacataacgttttaatagtaaaatgcagattatgatatctaagcaagtgatggtggttcaaaataaatttttgtcatgttattgtttattcatttagtggagttatttttaaaatgtcaagcaaggtttttcttataagctaaaataatagatgcaggaaagctaatattcagaggaaaatttgctgtttttatacttatatgtatatttttaagggttaatattgcttactatagaatttattcctttgtgattatgaattccttgcatttctttctagctaagagttgatgcttgctgtacacttgagtttattgtgtgtatcttgtcctagttgcattaatagtctacacagtcaactatagttctcaaataatagtcatattaattgctaccagattattacatatatgaatatatattttatatatagtatatatatgtatttatgtatatatactttaatgatactaaatgtagatatcaagtcagctttttatacattatatccaatggacttttcatttgacttcttaacctctgaaaatgtagatcacataaactcttgaaaatatactatggcttttaaagttcttagaatatatcaggtaagtatattctacacatttttctctagatataccaccatacaaagatgagcattttatggtgataccattgcatagaagtaaatttagtatcaatttactttagttttctaatatcagtttctcttcaaatttttgagagaaaagtttaggcttagactgtcaatgcaagattgatttagaaatacatgaatttgatttttttccttttgggaaaattattttgaagcctgtagtgctttacttatagagagttttatattttaaaaacacctgctataatattttacaaaaaatgatttattatggaaataacttacatgtaccttttgataattataaggacattaaagtcgcaaagtgatctgtgaatgttcctaccttgtcttttttttcccccaatagttgttgctcattgttttggttctccatcttccttccaattctctaataatcctttaggatcagtacctaatcccagcaaacaaaaatattcaacaagtctctgcgaattacgatgaagaaaagatgaattttaattaaaaagaggtgagctattaatatgtattactgtcaactttgtgctcagtaacgtgggattcacagtaagaacaatgatatagaaagtcaaagataacaatacagaaatacttgttcagtaagcttttagcatatatgagctatctgaaatgtacaattgtgtgtcctatccatgtaaaagtttgcctttctgtaaaggaaataatgcattaggtaatgctgttaaacaacatagtggttaagactctagatgctagtgtaagactggccatattcaaaatctggctcaattgctcactgataatgtaaacttagacaaactacttaatatctttaaaccttagcttttttgtccatagaacaaggataatatcagtacctatctcattcagttgctgcaagatggtgtttagaagaataataaaattttaataaaagcttagttgtcttataactaaaatctattggaaaaactcatgcctgtaatcctaacactttgggaggccaaggcaggcagatcatttgaggccaggagttggagaccagcctgtccaacatggcaaaacctcatttctactaaaaaatacaaaaattagctgagcatggtgacaagtgcctgtagtcccagctactcaggaggttgaagcacaagtatcacttgaacctgggaggcagaggttgcagtgagtcaagattgtgccactgtactctggcctgggtgacagagtgagactcagtttcaaaaaaaaaaaaaaatctattgtttttaaaaatgcattgaccaagttagagaaatagttatataaggtaagttgtgtgaatgtatgtttttacatttattttgtaatataaagaaggctgtgtacttgtataatgcattcatttctaaaagaaataactgaatttcatattttcagaaagacattatgatgaataatttataaaattttatttattaaatatttagctttgttagatacaatttttcttaccaggctttgattgcagtagtaagggaacgtttactaaaaagccgttgttgtctcacatatgtccttatgctgatgtgtcatttgtaaatggagacactggatctttaatgctttttccccctcaaggagagttcctaccaagtagaaaataaaactggtttgctgatagtttttttaaatttacctattctatgcattgttccagaatggatatgaaactttcattattgagttaggctgatttcattaccagtcaattcagtgaagaaagaaaggccaatcaaatcacatgctatcttgataaaacaactaatattatccatctacctacctatctatattattttacaatttcacttcatgtattttataggagcttacactgttcgaaaacatgttctgacttgtgtttatatacactttttttttggggggacggagtctcactctgtcgcccaggctggagtgcagtggcacgatctcagctcactgcaagctccacctcctgggttcacgccattctcctgcctcagcctcccaaatagctgggactagaggcgcctgccaccacgcccagctaattttttttttttttttttttgtatttttagtagagacgaggtttcaccgtattagccaggatggtcttgatctcctgacctcgtgataagcccgcctccgcctcccaaagtgctgggattacaggcgtgagccaccgcacccagccgtgtttatatacactttaagacactgaattgtgactacctcaaaattgtttggtccagcccagtaacacttatttacacagattagataccagacactgttttgggtgtggtctttcagcccagtaacacttactaaacacagattagataccagatactgttctgggtgtggtctccagaaacagatcagggacctccaaggatatattttaatgaaataatgtcacttttattcataaaatgatatctcccagattgcctgtgtggtatggtgtctctcaaacatttccccacaatactttgtatggcaccctatacttctctgtagcaggcttcacatttataaataattacttgtttatagcaatcacacctttgttagagcacaagttccaagaagataagtccattttattcattactgtatgcccagatcttaataatggctggcacttagcaggctttgaatacatttttataacatgaaagactttctgacattacctctgatggcaatatgagtcacatacctcttaagttatggggcataatccaaagctgtctcctctaacaatcagaaaatacctttgaagttccctgttttatttacttttaaaatgtatgatacttttaaattctcatccattatgtttcttttaatgtgtgttttgttattcttaaaaatggatactttaggaaatgtatcatggttttaaggatacatctgtgtgtggcatatgggctttggaattggaactcttgaaaatctgccttgatttttagcaaatatcttaaacttgagttagcagctgaaaaatggggctgagaatatttaccttgaaggcttttgttgttgttttttaagagagtaaaatgaaatgtgcttaaagttcttggtttttgtttgtttgtttgagacagagtctcactctgtggttccatggtggagttcagtggcatcatcttagctcactgcagccttgaatttctgggctcgagtgatcctcctacctcagcctcccaaatagctgggactacaggtgcatgccgccatgcagctaatttttaaattttttttgtaaagacaggatctcactatgttgcccaggctggtctcaaactcctggactcaagtgatcttcccgccttggcctcccaaaatgctaggattacaggcattagtcaccagtcccagcctgaaatgtacttaaagttattagcatacataatataccctcaaatattgttcccttttccttttttttttttttttttttttttcgagacagggtcttgctctgtcacccaggctagagtgcagtagtgcaatcatagctcactgcagactcgaaattctagattcaaatgaccctcttgagtaactagaactacagatgtgggcacccacaacctgctaattttttaatttttttgtaaagagggggtctcactatgttgcccaggctggtccctttttccttcttactagaaaatttctagctcccttccaagaatctcagcttatacctggttctttcaatatgtggttaataactgtcaactaaggactgaaagtattttcaatccttgagccatgcctatggctcttcatctgggggacagaactctttaactgagtataatgaacacctcatagattacattttctaggcaaaatttttaaccaatgccaacaatgtccacagagaaaaattagattgaattaacttttattactacttgtttaacacagatttacttgtcttagacaagtaagaatttatagaatctatgctctattgcactatatagaaactagaaatgcagttatactgatgtagtgcagtttgtgggaaatcaggaatggtgttctccagaatacatgaagattctcattgattgttgcaaggaatcacgaaagagatctttggtccaaagaaaacgtctctgaaagaaaatagagcatcaattaaattcaccttaaggctaagatattagttagtctattctaggttaaaaatagacagtgatttccaggatttcagttatgattattctttttaggtgactaaaatgtaaagagatgagtgggaggacttgccacagaagcaacaaagaccgagaaggtaatcgatttgtctactttccccgcatttgccattgatatcatgctgtcatttacgaagaaaaagaaatattaggtaatttcaaaactttatggtcatgtatacaatttcatgtctcttatatgaggataggccatgaagtttaaatctgcagttaggaaacagaagattcaacatttcttgtttattaaataaatttctaggttttatggggaaaggagaaatgttacaaagctacttaactttccctggttgaaaagatcacataaagtaatatataaaaatgcatggaataatacaaaattatatacaaatgcaaggtgatattataattatggcttattagaaatatacttagcagtatttctctttgattttcccaaaatcaagtatacccacactgctgttctcatcccttaacagacataatcacaaaattatatcataatataaatgtaagtccatttcagtaaactgttttcaagtcatacaaaaaaaaagcaaacatggcattttaatattagttggcatttcatttatgtagtacaggaaaaactgtcacttcatgagattaattaactcaagttcttggcatcattgtttagtacagtgattcttaaactttactatgcattagaatcacctggcaggtttgttaaaacataattgctgggtcccggccgggcgcagtggttcacgcctgtaatcccagcactttgggaggccaaggcgggcagatcacgaggtcaggatatcgagaccatcctgaccaacacggtgaaaccccttctctactaaaaatacaaaaagaattagccgggcgaggtggcgggcgcctgtagtcccagctactcgagaggctgagggaggagaatggcgtgaaccagggaggaagagcttccagtgagacgagatcgtgccactgcactccagcctgggcaacagagcaagattccgtctcaaaacaaacaaacaaacaaacaaacaaacaaacaaacaaccataattgctgggtcctacctccagagtttctgattcagtaggtctggggaggagtccaaggatggatatgcaattttaaaaactcaggtgatgctgaagctgctgttctgggaaccacactttgagaaccagctggcttggtagaagaaaaatctgttcttaatcagaacacgtgggttctaatcccagtgttgatattagctagttatgtgggatagtactggtcacttcaactctgcacctttccttggtaagatggttatatctaccttttctatttcacagatttcttagaaggatgaaaatatgatgacatctgttgaaagtaatttgaaaaagctaatttcaatatgaaatatccaagaccatgggatttgaaagattcctcaataaccagggggaaatgattttaaaatcaagaactaaaaatatttatgaatttatctaccatcattttatacctttttttgtttgtttgtttttttgagattaagtcttgctttgtcgcccaggctggagtgcaatggcacgatctaggctcactgcaacctcctcctcctgggttcaagtgattctcctgtctcagcctcccaagtagctgggattacaggcatgtgccaccatgcctggctaattttttttgtatttttgtagagacagagtttcaccacgtatacttgtattttaagtacaaaacgatagtagataaatcaataaatatttaagcttaaaatataaatagaaaacaatggtagataaattgtcttgaacttctatctagttcatttctggttaacttatacatagagctagaaatttatttttgaccgttactaaacttttctgttcagttaattacttgatccattcactgagttttttgttgttgttgttcgtttttttttttttttttgagatggagtttcactcttgtcacccaggctggagtgcaatggtgcgatctcggctcactgcaacctcagcctctcaggttcaagcaattctcctgcctcagcttcctgagtagctgggattacaggcacatgccaccacgcccagctaattttgtattttttttgtattttgtattttgcatagaacggggtttcaccatgttggccaagttgatctcgaactcctgacctcaggtgatctgcccaactcagcctcccaaagtgctgggattacaggcgtgagccaccgggcccagcctcactgggatcttttatctaaaaccttttactggttttcaagttggtttaagagttcaaccttgagattgacttctgctactggtagatttttatttttgggggggtaaaaatcagatggtgagtttagaatttaatagattgaagtattattttctggatttaatttacttttattaaactcagctaaattccatttgaactttcatttaaatgaaaacatttagttctttacacaatagtgattattctagaaaagagctgggattggaacaggattttactaaaagggttattaatttcagcaaacctattatgaagatgtagctaaaagttgttctgcatacatttccaggcaatacactttgtgataccatttccttactttgggcagcagagcaattcgctgaagttgcagtaacagatcatctcacatcccttcccatcccagaaatgatcctggacattgacatcaatctgtgtcaggtcagctactccttccggaaggttgtgacagttgtgatcttttagtatctttctgtagcaagagaggcgatttgcaggcatggcttgaactcctagcagcaaagttagcccaatggtgaaaacaagtaccatcagtttcattttggcttttggccctgaaatagaagaaagaccaaaatgtgtcaatgtttgttttttaaagatagaattcatctgaatgaagttctgtagcatgcttataaacccttggatagaaagaatgggagttgggcttttctacaatcctgtttgtgtttctcaaagtgtagttttatgaccatctatgataaaaaaccatttggaatatttgttaaaaatcaaatgcgcaggcttctgggccaggcacagtggctcatgcctgtaatctcagcatgggaggcctatgtacaaggattgcttgaacccagaagtttgagaccagtctaagcaacatagtaagaccctgtatctacaaaaaattaaaaaattagccaggcatgctggcatgtgcctgtagtcccagctactcaggaccacttgagcccaggagtttgaggctgcagtgaaccatgattgtgccactgctctactgggggtggcagagtgagaccttgacacacacacacacacagtcacgcacaggctgtaggcagggaggaagtgttggtgggggctgcaatctgcatttaagaagtacccaaagctatatatcttttgaacattcagtagagaacaactgttttttaaggtggtataaactcaggcaaatttctagaacaaataacataattgaatacagtggttctttaccttacattatcttacatcctaacaacattgtcaaagtacctgggtcccatcctgacagaaacaaaaaacccatttatgttgatagtgacagatgatagtgtatagatatatttatagtttgattgttttttaacttccagaagtagtttagtacacattatggttgcaaatttttagcaatgcttggatttttatcccacatagactacttcctcttagctgcagttgaaaatgaaggcttgaattcctgcgttataatcatctagccttccatgaactcctaccatgatggggaactcattattaactaagtcaacatatcccattgatacagttctaacatttcccttattgtaaaatacttttctgtggcttccacccactaatcctagtttgaaccctgaagtcataccaacaattctaatttctcttccaggagataatttttcaagtacaggatttgcatagaagtatagaatattaaatatctatctaattagacttctctggtttctacattagatgtgaagaaaatggagactattgtagtaaaggaagaatagcaaaatagtggaggaaccaggattagaatccagagccattcagattttatcttgttaacaggtgccaaagtatctttccttccttggaaagagggaaaacagatggaggacattgtacttggaaagaaaacaatattgtggaatagccagacgtggtggctcacacctgtaatcccagcactttgggaggccaaacccggcagatcacctgaggtcaggagtttgaaaccagcctgcccaacatggcaaaaccctgtctctactaaaaatacaaaaagtagccaggcatggtggcatgcgcctgtaatcccagctacttgggaggctgaggcatgacaatggcttgaacctgggagacagaggttgcagtgagcagagatcaagccactgcactccaccctgcatgacagagcgagactccgtctcgaaaaaaaaaaaaaagaaagcaatattgtgcaatggacatttttggtataaagtttttagtgattaggtatcttttaaaggtaagtcattttagataagataatggatttttaaataaatacatttattgcttttttccctttagattagaaacaaagtatttcttcatactcctaagagtttcagagtttctttgtctcacattctaatttgagttagccatttttggctttggctatatatttccttagaattatcaatatccaatttaattcctacctccaaacattagtgaaagaaaagactaaaatgagatctacctcattttatatattttcagatttaatggactaagacattgcagtgttacagtgcatcacaatccagcatatataaatgatatcttccaatgggctttttgtaggtcatggtttaagtgacctaatatgtgatctatcatggagaattttctgtatgtacttgagaagaatgtatattcttctgctgtttaactgaacattctgtatatgtctgttaggtccatttggtctacactggtgttgaagtccactctttctttgttgattttctgtctggttattctaaccattactaaaagtggagtattgcagtttcctactattattgtgttgctatttctcattttagttctgtcaatatttgttttatatatatatatgtgctctgatattgagtgtgtatatatttataattgttatagcttcctggtgggttgaccctttcatcattatactttcttctttgtctcttgtgacagttttctacttatagtctattttgtcagatatgaaatagtccactctgctttcttttagttaccatatgcatggagtatcttttttcatttctttactttcagcttgtgtgtgtccttaaatgttaagtaagtcatttgtagaaatcatatagttatatattgtttttttttctttctgctaccctaagtcttttgattggagagtttaatccatttacatgtaaagtaattattgatagggaagaatttactattgccgtttagcttattgtttctagttgtcttgtaattagttctttggtgcttttcccccctgccttgtcttcctttgtgttttgttggttgtgtttttctttttcttcttcttcttctttttttttccgatatgctttgattcctttctcttttgtgtaaactgctataggtatttccattgtggttaccatgaggcttacataaaatattttataattggccaggcgcagtggctcacacctgtaatcccagcactttgggaggccgaggcaggcagatcacgaggtcaggagatcgagaccatcctggctaacacggtgaaaccctgtctctactaaaaatacaaaaaattagccgggcgtggtggcgagcgcctgtagtcccagctacttgggaggatgaggcaggagaatcacttgaacccaggaggcagagattgtagtgagccgagatctgtgccactgcacctgagtctgggtgacagagagagactccgtctcaaaaaaaaaattataattataagtctgttttgaggtaataacaacttaacttcaatcacatacaaaaactctacacttttaattctctctcaccacactatgttatttgatgtcacaatttacatctatttatattgtgtatccataaacatattttaaattatagttattttaatacttttgtctttcaacttttatgctagaatcaaatggaattcaaccaccaccattttagtaatatagtagtcagtatttgtatatacacttatctttatcaatgagtttcatattttcttatgctattttgttgcatttaacaataaagatgtatagagtatttccttataattaaaaagaaatctttttcttccattatggtctttctatatgttgctctctctaccaggaatgttcttttttgggctagttttttgagttttaggtctcagtttaaatgtcattccttcaatggcctttcagtctaaggtagtttcaactttgttctttcatagcgccctttcttttccttaatgatatttatcacaatttaaatgatatatttgtgaatttactcattttatgtctgtcattctcattagaccgaaggctccatgacaacaatttattttgttcactaccatacaccagtggctaatacaatgcttggcccatatttgaaaatgaatgattttccaaaaacacattttttattctaggcaagagcctatagaggtcttatgttgtctaaaagaatatatggacttcttgggctaacctaaggccttcctttcactttgtctccatgcctatcatttattcctgttcagctagccgggcagtcaagccagtcatctctttaatcctatgtatgtgtctctgccttgttgttccttctcaccccttcccttgatattaatttctgaccaaagcatccatgaaggacaaacctcacactcatatcttctaagaatccttccctgatttcagacaatactactctcatagctcccttgctctatgttcccaaagcacttatatataatctggcctacaagaactgtgaatttgagtaaataatgccttgtcattgtcagcatttttataagctggttaaccatttggagaatatgactacaattggatatggggagtgggaaattcatagagctgattaattatttagtgaattggttattatgtgaatttacctacagccaagaaggaagattgggaacaatcataaagggcctagaagatatgataaagagtttagattttattgagtatattaagaagccattggaagattttgacagaacagtagcatgatctgatttatgcctttttaaaaaaatccctggctggcctgtgaagatgtattgtggtgggacaagattggaaatagaagaaaacaggcttttggtgagaactgatgggatatatgaagcaagagggaaagaatcaaggatgactcttgggcttttggcttgaatggtgttgtcatttgttgaactgaggaagaattggaaggagccaattttggggggaatccagaaatgagtttttagacaagttaggtttgagatgcctgttagatattaaagtgaagatgttgagtaggcagttgaatgtgagtctaaagatcaggggtgaaaatacaaatttgagagtaatcaggatatttattgatagtatctatagctatgggtctggcagggcagtaaaggtagatccagaagagatgaggcaaagggctgaggcccagggcaattcaatattcagaggactagaagaggagatgccagcatcaaggcagcaaggactgtaacttctacttcttttgtattgaagcagagtgcctgcttcaatgctgagctcacagtaagtgttgaaaaaatttccttcagtgaaatgaacaaataaattgctggtaaaataagtaagtaaattgccataccacatacctcttctgtgttcatgccagagcataagatcatttttttgccacagtctaagtcgcatactacaatggaaagttccacacctagcaagtacctactggtagttttgtgtgtgtgtgtgtgtgtgtgtgtgtgtgtgtgtgtatgcattataaattacatgttttggcccagcacagtggctcacacctgtaatcccagcactctgggaggccgaggcgggcagatcacgaggtcaagagattgagaccatgttggccaacatggtgaaaccccatctctactaaaaatacaaaaattagctgagagtggtgtcatgtgactgtagtcccagctactcaggaggctgaggcaggagaatcacttgaaccgcggaggcagaggttgcagtgagccgagattgcaccactgcactccagcctgcgcgatggagccagactccgtctcaaaaaaatgaaataaaataaaacaaaataaaataaaataaattacatgtcttaaatgcagacttctcttcttcctttacttaagtacagataaatagctttaactattatttagcaaatggaaaaatttctgacccagtgtgttcctgggatacattggttgttgtttcattaaaggataccaaacttaatccttggcaatccatcaaaaccatatatgttcaagtgccaacaagagtgaaatgattttggccaatttgaagaaaattggtcttttttttttctttttcagttgaggtacatgtacttaaaatccctcctggaatacacccaaattacaaaagaaaacaaagttacctactaaaaattagaaggagtgagcaagagaagcttaggtagttatccatttttttaattcgattttatgtaattaacattgttccaaatgttgtatgataccatttatatcctaatagtgttgtaagttttaatagatcattgcagaggatacaggattatgagcaagacatttccaactaaacaataaatcattgctaccatcctttggtagggagttgcaaattttgattctgtctgagggcatttagcacaagcaagcttttgaatggctggagctaaatggagacttaaaaagaaaaattatcccatttaattgccaaaactaacaggaccatgcagtttaagtgttcagacatttatggtgcaaatgctcatacaggcagctgatgtcagttctgggaactggtattaagagcagtggcatgaaacagagttgatgaattagacagaaaagacagtccattttcggattgctttcaaaaaagcagcaagagagaagcaaagctgcaaaagcaaatgaaaactccagcccagaacttgacatttgaaatatcaaaattatagttgggagagattaaaattgctgcccagtctgtgatgttttccactcatctctcttggaggatgaaaatcactgtttttttaaagttctctttttttcttattagctgccttagaagacgtttttgttagaatgactgagtccttagaaaatgtttttgttagaatgactgagtcccaaagtgaaatttcccaaagtatgtgttaaagaacagaagcagtattaaaaagtgaataagctgcttaaagatccttaaaacagacatatcatcttaaatatctaagataccttcatccatagaaaaacaaaatccacatcctccctaaaagtgatcaggcttttagagcatgccagaagatgatattaatattcagtcttgcatcattctccttcttttcctggacacagtaaatcatcatcactggagaaaaggaccagcatttgggagagcttttcatagcctgtgtaattaagttaaggaattttaaagaggaatttttctaagtctcagagggaaaaagtgttctctttatattagcagtacagacactgttgtgttccaagaatggacaccaaggatgaattcaatgaattccctctttgtatcacacatttgtaccaggttcttttcagaaatcaggatttttaaaagcaaaaaacattttctttcttagatgttgcagttaacttcatgtagtgtaggtaatatagctgctgcatttaaaacaatcctatatactttatcatcctcacatagttctgaggactgggataagtcctgttgtgtgggacaacattcagagtaaatttgggcattaaataaatgatagtgaagaatctgcctctttttaaacctgtaatgaaatgactttcctagtcaagaaatatacattttctgttcttttttaatctgattatttgcctttctactaggaagcatcatatttttcaaagtgcctgcatcatctcctcagaggatctctgtctttctcttctgactcaacacatacatacatttctgctctaatctacagtaatactttggagtagaacaactgacataagatgttttttatagagaaaaaattacatacctttttcttctttccttttggtcttggcagaggatgcttcttaaatgctcacactcactgggtgagtttgggcaaaaggagaagagaggaggtgctggaaggagcttctttacaaatgaacctttgtctgccttgtctctggcctgggatcgacagactcgctgctccagccaggactgtggggaggaggggagtggaaggagacaaggctgcaaggactgcctcctttggaagtgttcagtttgttccaaaccaggcgagaacgaatagaacagcttctttacagagggaaataactagtctatacaagaacctcagggaggcagactctggtagcaataaaacataaaacctgagggattttaaaagaacacagagtgatttttcccttaagaaaagtgtgtgtgtgtgtgtgtgtgtgtgtttgtgtgtctgtgtgtgagagagagagagagagagaagaggaaagtggggaatggctagctgcgcacctcttcccctttcacagttttcctagccatctagatctgttacaaaatcctggtagaagatacgttccaattcaccttccatttctcacccaaagactcattagtagtcaatggaaagctaaaatgatgactaaaaagaaatgtattctgtgccttagaaataaaagcacaaaagaaattttattctgttttcagcaaactatactggaattctagcatctgttaactgttgtttaggtttttaaaaaattcgattaggagtagtgttttgggaattagagatattatattgtaatggagttggaattatctagacagacaattgaggcaagggcattccaggttgaattacaaaggcatgaaggtgaaaaagagggtgacaacttcggagattataggtggtttcatttggctaaaaccaaaggtggtaggagatgaaatttgagagacaagaagcagcaaattgatgaattacctcatatgccatgctaaaaaaattgtttttatcgtgaagatgaatggaaagatgatgaaaacatattaaaaaggatgaaaagcctgactgcagtgtgaaagaaggatggtttcctgggaggaaaggagactaaagacagaaaataccggcttttgctgtagtccagaagggaagataggaaggaaaactgaaaagacctgatgaccacttaagtgtttatgtttagcatagagataggaaattttattaactttcaaaggcttgggcctttggacgatgatactgttaatcatctagaaaaaggatataaaaggaataactgttattcatctaggaaaaagaatacaaaagttttggctggaggaggagtgggaaaatagaaatgagttagttggtgaacgttgagtttaaggaaccctaaatacagttgagaatgtttagtaggcagttggttaaatagacctagagcttaggaaaaagcctggtctagagaattagttcatcaaccaatcaactcaatatcaaataatctcaactaaataactaatgcaggtattcaactaaatgatagccgaagtcatggttgtaccactaagaagttactgtgctcttactgtgtgccaggcatttcatacgtctgaactcgttcactctccttccaaccctatgaagtaggtactattattagtcccattttataaacgaggggaacatcagagatgtcaggtaacctgccccaaatcacacacacagccagaaaatggcgagaccctggcagtgtgtttctagtgtctttgtttcccaccattatgctgtactgccccttagaatagattataaagttcatgatacgactgagagcagaattattcaaggaatgggcagagaactgggaaggaaactgagaagaggtagccaaagaagtaggggaaaattaggagagtgtcatcatggaagttaaaggaagagtatttcaagagaatggaggtgaatggaaggctgctaatgacagcagtgctgggagaacaacacgtgcacaccctgatatgaaggtaggcagagcaaagagaaggtcaatacaaccagaagcagttccagccctgacagagatcaaatctctgcttggtctccatttcgctgaaactggagcaagtggcatggacctcaggaagggagatgagaggtgtgtgcgcaatggactgcacatttcctttgcatatttataaacaagtctgctgtgattcttactaaataaagatgatgccatacacagatggagttaatttgtttgcatgatttaaatgtatataaatatgtgaatatgaggaggaaaatggaaactagcctttattccactttaagagctatccgtcctgtttacctcaggtagatctaaacagaggtatggtgccaaggcaaatcaacattccctgtagatggatcctctctttactctgttttactcttatttccctgtgtgtctaattctgtctaaatttcccttattgtgttgcttattttgtctccttgtgtctgaattcatagctgctcaaaatagttgattcatttttatattcagcaacactgaaatccatacaatatgcttggcattgtgcttatgaatgctgcctgtaagtggtacacagcagctcttggtaatgatctaatcatctctggatcatgttctgagccacttaggaaagttttcccctaagaagcacatttggaccctggcctccaaatcccttgtgttttcaaacatgtgtttattactagctggacttcctatcatttctaggaagaatcattaaacaatatcaaacttataattgcttgtcattcatcctgatgtccattacatggggatgtccttttgagaaggagttcaattccaaaccaaggcctgcaatcacagagtctgcctttgtggtttttaatttgtggctcaaatctgaaaccactctttgttttcctgtaaatggagccttaaggccttttagttttctttcctgatgggctgttactcagacctcttatcgaacccgctttatgttgctctgaagaccacctgtttctttgagacggcctcaggagcctcccaaagtgaatcttttatgtgacatagagcttctattttaagtaaaaccatccaaatgtaatgtacagatttccagaaaatatgtccagctatgtatttttatgtgatgatgatgacgatggtgatgatgatgtgtgtgtttatttctataggtatatgttatcactcttaggtgcagtcaggtttgttagaaatagaaaatcctcacaaattagtgataagaccaattcgtgagtagagaaacattttatacagaatttaagcaattacattcaaagtactgaaattaaatttgtaaagagacctaattagtatttctttttaaaaaaaaaaaaacctcccaaaattgaaaaattgagaaaaacaccaaaaaacagcaaaatccttccaatcaggtgaagtctgaagagatgtctcagatataaataatttcagatatcagacatcttaagcttgtgagagaaaaaaaatggaacatgcattagttcttcctctgatgtccacctgggagctcatgcattcaccctaatttagaatctgctgctcctctgttccatgattgacccctttctctcatttccctcaggcttgactccttctgggctcaccaaggctggcagtatggggagaagcagcagctggtttcggccttcacagctcacatcttcccaggagagaggtaggactttttttatgtgagtatccttgacaaaaggagcctcaaaataattgcacttattgaaaactaactcacaatatgcttgttgaaatggtgatgaactgcgacaaaatcacctcttaaaactacctttaaaatctttcatcagttaaaaagaaacaagctattttactaacttatttttgaactcagtaaaagagtttcctctttgattacaactatataaagtttcccttaagatatccactgaaccttggacatttatgcttagaattgtttttgaaagtgggttgaacaacataacctctattacccaaacttagctttatgttgctgaagtgagactcaggaaaacaggttctactgaggaatcgtcagtaaggcccttgaagagacagcagaatcaccaagtagctgttgtgtaagagggtgaactgatgccacctcccctgcagggagagaaatgcttccatgaggtattcatattggaatgcaatttcgatggtatgatgtacttgggaatggctaggattcccagatgggcaaccctggctataatggggatagccaggagagtcttcttgatcaaatgcttttagtcagaatatcaaacacaagctctcttttccctgggcatagagagtaaggcacccaccttcgtctgcgccgccccgggaatgctgggctttttaacagaattgatacatagagactgtaaggttactcatgtaaccatgagtaacatgattttcaatgctgcagaaataaagtcagaaaaatgaacatcaggagagacctgtgtccaagaaaactatccacttttaggagcccatggaatagttagaatgaatggtaatgttaatatgaaaataaactttggcaagaaaagaggccaagaaggaaaggaacatgaaaataacctttttagtttcctggcagtctctaaggggcattggactggtccatggaatcacagcccagagcctagcaataattttatgatttattggagacaacctactcacttaccaaacctagaaagatggaaagattgactaagtgtgtcaacgtgtattctttcgtaggtcctgagttattgccctaatcttctcaaagctgtttcacagacacaagcatctggtgagttgataatgttaatgataatagcaatgatactagtaataataatgctattaactgcattgccaagtgtgctaaacattttgcaaatgttgtcttatttagtacacgcaacttacttacatgaggtagtttccagatgggggaactggggttcaaaaaaattaagcacttggccaagatcacacagctgataagtagtggagcacaaactggaaaccaagacaaaactgtgctcttagcctgctgccacaataaatagcaaaagaaatagaatgagaaattggagaacctaaaacaacagtacctttttaaaaaattgtagcccataatttgaatgtgcatgaatcacacctgctctctgtgagccacagagtcgtctctcttttactgtgtttcctccgtccatcttctgttcatatttggcttgaaacagttcttaactggacagtcagaaacttaaagcagctgaatggtgttttctacaaagtcagatatggacagttgccaaaatatcagtccttgggacagagtttttaagtgattataattctaggagtaaaaccagtcactcagtaaatatttgttaaatgaatgaatgagttaatgaataaatgagtgaggggattagattcttgggtacaggagaggttcttgggaagtaatcattcataattatttattgtgtgtctgctgtgtaccatgaatgatattgcagtgtcgctgaaggcaaagttcagcaactgatcactatttcttcaaggtcctctccaaagcacaagctacttggccagcctggctgctgagtcctaatgtaaaccctcagtcttctcccttgtaaaataaggggtttaattgattgtttttattgctcttctacttcccatttttctatgagtatatgattctaaatatcatttttaaacaaacatttttattttaaaatagtttttcatttacagaaaaactgttagcttagtacagagacttcctatataccctatatccagtttcctctattatttaactcttacattagtgtggtccattttttataattaataaatctacattaatacattattattaactaaagttcatactttatttatttgtacttagtttttaccttttctgttgcgggatcccctgcccagaacaccacattacatttagttgtagtgtctcttcaggctcctcagtgtctccgactttgcctgtttttgatgactttgaccgttttgaggaatactggtcaagtattttgtagaatgcctctcaacttagatctgtctaatattggtcttatggttaaacttgggttatgtgtttgtagaaagaggaccacagagttaaagtgccatttccatcatgtcatatcacacatgaacatacaggtcaggaacgtgacttatcactattgatttaacttcaatcacctggctcaagtcgttttcgttatgtggctccactgcacatttactctttttctccccctttccatagtacactctgtggaaggaagtccctatgcatggtccatatgtaaggagtgggaagttatgctctacctctttgagggcggagtaactacataaattttggagaatttttcttcacatgaaatttgtccatcattgcttatttatttacttgtattaggatgaactcatgtatatttattctatactttggattattttatactttggattaaaatattccttgctcaaactgtcccagcttttgcctttaggggctcctttagttgcctcttgtgtctctatggcatgccccatcaaggtcgtggtttttggttttgttttgtttttgtgcactttcttcctttctggcactaaaagattgctccaagctcatcttgtgtatttcctgtcccagtactagaatcagccatttctccaaggagccctggttcctttcattgaagaataaattagaaaccaagatctgggagctaggtgtgctcactagtactggtgtgtcatagcttctcattcctctcagctgacagagcaaggaaatatactgtgtataccaacctgtgtaaatacacatatctatgaatattgctatgcataactgtctgtatctacaacaacctaaacatgagtttattctgatgcctccaactctaatccattactacgtgaatcatttgagcttcctcctcttgctcatctgtaacctcctgctccagcagtgggaacctaactcctactatcagccacttatttaattgttcatttccagtatacatgtatagcagcatcggaattgttggcacatacctcatggtaaacaattttatcagctggagtacagtgtttatatacggtgtcttttacctttagtttgacagactctactcatttccaaagttacataggtctgcaacttccccctcactacgcctttcagtgaggttgtttcatacatgagtaataaagttagattgttttgtcacattctgtttttatcctgggattgtccaacctcctaaataattgttagtaatttgcatgtattaaggttcagtctttgtgctgaaaaggtctgtgggttttgacaagcacatagtgtcttgtacataccattacattatgatacagaatagtctctctgccctaaaatatctcctgtggtttacctattcaaccctcccctccctcctaccctgaactcctggcagccattgatctttttaccatctctatagttttaccccttctagaatgtcatataattggaatcatgtagtatgtagccattacatactggcttttttcacttagcaatatacatttaagattcatctatgtattttcatggcttgataatttctttttatcactgaataatattccattgtatagatataccagtttgtttatactttcacttgttggaggacatcttggttgcgtacagttttggaaattaagaacagaggtgcgcgctgggcatggtggctcacgcctgtaatctcagcactttggggggccgagatgggtggatcatctgaggtcaggagtttgagaccagcctggccaacatggtgaaaccctgtctctactaaaaatacaaaaaattagccaggcatgggggcacatgcctgtgatcctagctgctcaggaggctgagacaggagaattgtttgaacctgggaggcagaagttgcagtgagctgagatcatgccactgtattccagcctgggcgacagagcgagatccatctcaaaaaaaaaaaaaaatagaggtgctggggctggatgcggtggctcacgcttgtaatcccagcactttaggaggccgaggtgggcaggtcacctgaggtcaggagtttgagaccagcctgaccaacatggtgaaactccatctgtactaaaaatacaaaaatacattaaaaaaaaaaattagccgcacatggtggccagcgccctgtagtcccagctactggagaggctgaggcagaagaatcacttgaacttgggaggtggaagttgcagtgagccgagatagcgccactgtactccagcctgggcaacagagtgagacttcatttaaaaacgaaaaaaagagagtagaggtgctataaatatttgtatgcacgttttgtgtggacatagttttcaatatctttttaacatttatttttcaggtcaattaaaatcattatttgtaataatctagcctttatgcagcttctcaaatatagctattttaaaaataataaacacattcatataataaatccattcagaatcagacaccattttgtataaaagtgtaaacaatgaacctgcaattattttatggaataagataactttagggcagtttagcagtatttcatttaacattctttgaaatttgagcagacctgtggtctatggaagctgtttcttttacactgcaaacagggaaatttataggtgttaaatttgctataaaattgttcctttattgctcctttactaataaaacattaaaaattacatatttggaaatctaaataaaagcattttcaaactgaaataataaatacaacacagtattagataactaaaacttgctccctttatgtgtatacatatcagataggacacatgaaatgccaggaaataggcaatgatgatattttctctggatatttaatctctaaacacatgaaatatattacatacagtataatcctgatgaaatataacttgttattccagaggattgggtatgtgttagagagtcacctatgtccactgaaagtttaaagcatagcaacaattctacgaaaaaaacccacacctttctataacactgtcttctatcaaatgacaatttgatcaaattaatctttgcctttaatactaatattctaaataagcctccttctttgggggtgaattaacaaaaattgcccctggattgttactaccttacagaatttttactatgcttccacactctatgttagtgactcgtgttgattggtccagtatggctcaagtgtaaatatcttgacattagaaagatttaacaattttaagtgatttattatgtgtcttaagctatcttatgtctatggtttattttatgtcttaagttactttatgtaaaatatttgagaaaatagagaaggataagtatctgagaatgaagggtttaagaatatcacacaagttcaatgtctttcccctccccatagaaattttgaccattttagtgtcagaaaattaatgagtctgctaggcgccgtggctcacgcttgtaatcccagcattttgggagcctgaggcaggcggatcatgaagtcaggagattgagaccatcctggctaacacggtgaaaccccgtctctactaaaaatacaaaaaattagccggatgtggtggcgggcgcctgtggtcccagctactccggaggctgaggcaggagaatggcgtgaacccggaggcagagcttgcagtgagccgagatggcgccgccgcactccggcctgggcgaaagagcaagactcagtctcaaaaaaaaaaaaaaaaaaaaaaagaaaagaaaagaaaaagaaaattaatgagtctaaagctatctcagcaaataatgggattttctttcctgacctaaaaggttctgagatttctccattagaagcctgcctcactgagaggtgaggactttttaaccaataagcctggaggttttagggctttagtttagcataaggaattcaggagagaatccctgggaatgtgattctccctgaagcaagtcacatgttatgatacattagatgggagcttctgtggtagaccatgtccctcttaacattataacaggggaaatcttccttctacctcttttttcataccccttacctgtgtgacagagggcccttcagatgcttagctgcctctcctattctaggatctctttctgtcctttgattttcatctttatctctctttctccatgtctcttcctatccttttgctcccatgaaactatttgtgctatgctctgtatccttccaggttgtgactcatgtcccatttgaagctggagaagcagcaagatagactaagatatgaattccctggatctgcgttggtagttccctgcatacttttttttttttttttttgagacagagtctcgctctgttgcccatgctggagtgcaatagcgcaatctcagctcactgcaacctctgcctcccaggctcaagtgattctcctgcctcagcctcctaagtacctgcgattacagtcacacaccactgcacccagctaatttttgtatttttagtagagacagggtttcaccatgttgcccaggctggtcttaaactcctgacctcaagtgatccgtccgcctcggcctcccaaagttctgggattacaggtgtgagccactgcatccagcctccctgcatactcttaagtatgccaatattaggtgagtggatatacatgtcactggaaaaagaacattttgtggccttacaatggatgttcttttcagtatccccctgacatggcaaaacaaacttaccgagtgctaaagatcctccaggaggaaagggatgaagacctggggaagggatctccgtcccatttgagattcaacctaagtaaaactttctgaagggctaagatagctctgactgaggtctcccaagaagagagagtctggctcagtgacaggttcaacaccagagcgtagaggtttgtggggacagcttgttctagatcctgtgtgtagctgtggttagaagcccaattatacccagccactttggcaaagctgtcatgtttagggaacagtggctgattgtgtgagtgtaaacccaataagctgttgtcttgggcgtccatatgcacagtgctaccctgctgcctgtgcagtgttccatagcagcaaggccattcctacagcaagacaaggactcactgaagcctgatggaatcagttttcaacagtgacattgtacagaagttatgtttaaaaccagaacctgttaatggactggtcacatggaccactgaaacaagactactacctttggactaagttaattctcaggtttctgtacaacagagagaatgaaggttccttaagaaagagaaaccaaattacctactatatggaggaatggaggcttaagcaagcaattggaaaaataaagagagatccccaaatttttcgtcctaaactgatcgagatccctacagattatatttaatatgctaactcattgtgaatctctaagagctgaagggtttgctaaatttgtttgactactggactttttaaaaaaaactatatatctcaagagactggactctaaggaacacttgttataatagaaaatgcttcttcggtgacagaattttagatattaggtcatgacaaaggagcagcacattgggagcagaggccctttcctggcacccacccatatagttgtttgactgtctcagagtagactagttctggggttctgtgctgttaatcatgttgctctagtgactctaacccaagaagggcagagtgtgcagtgagacagtgctgagatgggattccaacttcctccttagctccatctatcattattagcctttgaataatgcccaccacctgcaattgctcgttggctacatgagagtagagatttcccgttttattgttttatgcatcctcagtgtctagaactgtgccaggcaccgtttaagtactcaataactatttatcaaatgaatgaacttctgatctaacactgtcctggcaaagacactaaaagcctaacttagcaatttcttttgtacagtttgtaccttgtggctacaaagattcaggaagtatgagaacagtgatgacttggaactactaactaggtttggtgggcccagtcctcagcagcaaacagtaaataatgttttatttgtaaatcaagtgaaacctatcttttcccaggttggaccaacccagaatgggggtcggggttacaaccatctcaaaccacatcagctgaatcaccatccccctagttccacattgctcaatctgaggataaattgcaacatatttagcaacctgtatggtggcatattttaataaataaatgtatttctataaatcagtatataaataaaaattaaaaatatttcctttctagtctttaaactatgtatcatgaaactgtttacagtgtaatgtagcttacaaggcaacattttcatcaaatcattctaataatttctaaatcattattgatttttagaaattaatggtatggtcttatgtttggtaagctctcactaaactaaatgctgcttgtctctaagctacagttttatggaggaaactgtactaaatgcttccaatggcttctccttgtgtcgatggttattaggtgtggtcccaggcatgtgcctcagcaggagagtgattgggtggggtgcccactgtgtttagaatgctagcgtttttcacctcatctgtgtacccagagtacttttgcttctgccccatctacaaccctgtcactagcccagcttgttctgctactcctgccaaccctggacccctcctgagcagcaagtaggcactgtgtctgtctcagcttccaccttggtcttcttatatcatgctgccctgtccagatgcaccagtcccaagtcccaaaaccactcatgcagtggccactgcatgatgtcatttggtggcatgtggtctaacttaagctacttaccaaccatcagggcagaatttccagtttctacctgcagtaacatcatgcctgtgtgtattggctgaatataagccatggccccgtctcttctgagtagttccgcaaatctcaaggccatctctcacatttatgttagaacaaggccatgaatgctgttttcttctatctcatgatccctaccatttcttcttctgtttctcacctcaataaaatggctcccatgttgatgccttgattcccggaaggagctactgttttgctttgcctcttaacatcgctcaggtgatgctgcccttgctgatactctgtctctgagctgaagcaggagaaaatcccctctgttggcctgagtggcccatggtcaccagcccaaggctgcctcatgctcttcgtgacttactgcttgctataatcctgagtctgtggatgatcacatcagaaaacgccctcagtttactgttgcgtcccactgcttcccatcttctgaattaagactgcacattctggctctttgccttgggtaatcttttcccccaataacttgggagctttgattccaagtggcttaggagagttgttctccacacagctgggtaccagaagcagccagctgaatgggaccaaggcatgaagactgaaaacctcgcaggtgacttggatcttcatcccaggttgagaatctctagcttaggagtctcttttgagtcctaaaggaaatactcaatttcccccatctgtcaggtccctgccacatctaccgacatgtgcaatgggattaattcttaagaaattcatatacagcttagactgttgctcagagactcctgccactctgtgaaccacccctatggacactgatgcacaatttcctttgggttgatctcataagttgcatttccaaaaaaaaaaaagaaagaaaataataagaccttgacatcataaggaaaccacttttagttgctccatttcctggagcctacagctggcaaaatgcctgggacaagatgtattcaattcaaggcaaagcagagttgttaggagaagcagatggcccacctaaggtgaaaaaattactttcttgtgaggataggcagggcagtttattcacctcttcctctaggaaggtgagaacgtgtggagacaaaataaataaaacacattacaagctcattccacagatgaacagaacaattggtgctgaacaagtctacaggaggcatcttccagcctccaggaaagctgtaggagcttgtcatgcatgcattaaagtgcccccagaactcgaaaaccattccatcagaggagctaataagaaccaacgagtcattgacaacagcaaccatcagtaaccctctctgagagctggtaatgaacagcaacaaatattggggatagttaagatgagccaggtaaaggttcaggaaaatgactgaatagattacaggcagcaggaactgtgatccatctgaagaaaaaggggaatcatgtgagtggatgtgtggcagctagaaaatctgcacatattgaggtaagaggaggccaggcagtgagaatttgttgtgattatctaactttccagaggagagagacatgtttcttggtagctactcatgttcagattatctagaaagtacatttcattcagaagtcttctccaatatctggatgctgcaccccttaaggttatgcaatgcttttgctctgaatccttgttcacaagcaacaacctgattatgaatttggtctcccaggtaccttgataatgggcagaatgtgtccaagattgagggaacaagtttggagatccttggaaaggcttattgtgtacctgttacaaataaataaatgtgggttttgtttgagagtttggttagcacgggtcagtttcaacctaatcacccagcaacacagacaaaatcctctcttgggacctgcatggctgagggtcagaccccggaacactttggccactcctctgtattgccatcctgtgaggctccactggagcagcctgggccttcctccctgacatctgtgcctgtttaaatttaacacaatcagcccagaaagtcatctcctcaccagtttctttaaaatcaacagaggataattccaagtaatgttttctgtaatgcattctggagtctcatagccctgaaccttaggaaacaagttgcatctcacactctgtgagcatctacccaagtagcaaactcagcttcctgcagtggtccctgctgtcttcttcaccctgatggggtgagtcttggtgaggccacatggtgacgtacaggggatccttaagcaaggagttggaaaggaaaggttacgctgccaagcacagctccaacccagagccctcatgccctcttgatcatgtcgtttgaatgggggatggcttaggttaaatgaagaaaggggtgggtgttctcatctacaagagcagaactagaagggtgcttcttgtcagctgtgttcacagcagctgtggctgggtgcacagctttccccatttttccactgttgaaaagagtgtgtgcttctgtggctggtgctggcattctcatccctgactcttgtaaaggtgcaacatcatcacttcaagcactctctcttagttttctcctccctagggtgtgaatagttgacatcgtgcactccttggtgggcactgcgtgcttgcttgctataggacacttgttcactggtattttggtaaccagtagtttttgcctgtctccagaataagagggaagcagcagtgacccaactctggaaattatctaccaggctcacatcccatatattgccctatatcccttgaaaacagcaaatttatatgcacaataaaagcgttaatattgcatgttaatttcttcttcccccaaattggagagttggcagaaggactaataaagatgactagtgtgaatagtctctcaaaatagtcatttcataaattaaataggagatgcattcactgcagctgagatttatgaaagttctgtgaggtggcaaaacagggtttgcaattcaggattttattgcccttaggggctgtggctaatctgttgtgaagtgaggtttcagttgggtaaagattgagtaactagaacagagatgcattgtgtaacccccgtttcctttttatttcttgcggaccagtgaatatcctaagtcccaaactgtacgccagcttagtagatttaatttttgagtgttttgtatcatgacagctcagcatttcttgcaaaaagtggccccagataaccatggccattatatcagtctctgtgctgatgctgaatttgtctgacagactcacacaggggcctccaaatagccttttctttaaagggaaagagaactggcatttaccaattacttagtctgtctccaaacgacctttatttctcatggcaaatctgtgacattggtattacaggtatttcacctttgttctggataggattgaggctcagagaaaccaaatagcgtgcccaagttacttaattaagaaccttagaagcctaaaacaaacatgatctcttctggtcagttttatacaggagaagtgaggtttcaggatttaaaccaggcctatctgcctccaaatccattgctccttccactgtgctgtgtggctgcatgaacacaccaagagctggagaaatgacatagggtcttaaagcaccaccaataaaatcatgcgaaagaaaacatattttgaaaaaaaggctgattgtcatattgaagcgccccactggcaagtctctaggaggccctggtaagaccagcatgtgcgcctcggggtgttttgagtacctgggagggcaggggccgtgcagtctcctctcccgcagtgtagatgagccagggagggacagcagcaatactgccgccccaaagtcatctgcccacttccagtcagaggccctaacgttttcctagttatctgagtgtcatctcttacgatgacttatcctgctcaaagcctctttatttaaacatttgccaagtgggagggattctgtcccgacaacggcctcctcatttccatgctcactcccaacgcacggctcagacgcctgtgcgcagatcctgtctgccataagaacctcccaaacgatgctccccgctgccagccactccttgtgcccatcttgtggctgctagatatatcgtcctacagcacagctccgatgatctcatacctctgctcaaaaggaaggaagtttccaaatttcaaactccagtgccaggcgcggtggcgcgcctgtggtccgggtgactgaggagactgaggtgggaggatcgcttaagcccaggagttgcaggctgcagggagctatgattgcatcactgcactccagcctgggcaacagagtgggaccccgtctcttaaaaataataaaaataaattattttaattgtaaaagtttgaaaccaaatttcaaagtcaaacctagaaagcgtctggggctatcccccggctcctggggccctctcccttcgtgtgacggcctctaggactagcgtgcttggtttgtttttggaagccatttcctcagagtgatggtttctgaggaaccatcagctgcaagagttctgctttataagaatatacacataagaagaaaatagaaatagcctagaactctccggatttcatcacatcatcacacacacacccaaacacacacacacacacacacacacacacacacacacacacacagtcacatcatcacacacaccacacacacaccccacacacaatcacatcttcacacacaccccacacacaatcacatcttcacacacaccccacacacaatcacatcttcacacacaacacaaacacaatcacatcatcacacacaacacacacacacacagacacacacagacagagagacacacacagacagacagacacacacacacagagcctttgtctttttacatttagttgttatttagcgccacctggtgttaaaactaaacagcacctctggagaaaaaacaagcatctacaggcatgttttaccccaaattgaggatctttagcactggaaggaaccttagagatcatttagacagatgcctcattttatagattaggaatgtatgcagatttagaaacagaattgaatccatagttcttgaattctagactcctcaattttccagcatgccccagttgccccctaagcctccaaaggaattgggctagagggatgccacctttggaaaaagacaaaaaaagaatactagcatttactgatcctttattataagccagttattgtgctaaatgcatttacagacatgacctcatgatctcatttcttcttcataactagtctccctccctccctccctccttccttccttccttcctcccttccttcattccttcttttttttcagagaggaggtcttgctctgtcatccaggctggagtgctgtggtgtgatcagagctcactgcagccttgaactcctgggctcaagcgatcctcccaccacctcagccccacaagtagctggcactacaggtgtgagccactgcagtagggtgatcttattcttgttccgcagatgaacaaagtaaaattcagagacctgcaacacaccttggacctgcaagtaattttatgtctgtgtttctataaggacctgttcattccagttgtctcagtggtcagtgtggattgccacatgaataatttggtggtggcttaaaaaacaaatatttacttcttgctcatgtttcatgataaatgcaggttgactgtgggtcagctataactctgatgggctcagcttggctggatgaataatttggtggtggcaattggcatagatcccaaaaaataaaagataatgaggagctcagtaaggtcatattgtattatttgttcacaattactcattccttccttgccttttccatacttctgtgcaggcagaatacattgccctccctgcattgaccttggacttggccactttcttttggttaataaaatgtgtgtgaacttgatatttgctgccagagcagaagctttcagtggtgtggtttggtgagacctgcttcagccttgacctcccccgtgagaacagcacaccttagagagttgctcttccttcagtcctggctcctggaaggagatgataattgtggctgagccaaatccagcacagctgagcccatcagagtcacagctgacccacagtcaacctgcagccctcatgaaacataagcaagaaataaatagtttttaaaaccattgagaatttggtgttgtttgttgctgcaccaaaagctgaccagtacggagtttgaacacgagtctggttgactccaaaaccattttagaaactctctgtgaaaatggacactacttccaggatgatgtctaatatggtttgggtctgtatacccacccaaatctcatgtcaaattgtaattctcagtgttgcaggaggggccaggtgggaagtgattggatcaccggtggggcggacttcccctttgctgttctcatgatagtgagttctcatgagatctgtttgtttaaaagtgtgtaacacttcccccttcactctctttcttcttctctggccatataagacatgcctgcttccccttcaccttctgccatggttgtaagtttcctgaagcctcccagtcatgcttcctgtatagcctgcagaactgtgactcaatcaaacctcttttcttaataaatttcccagtcctaggtagttccttgtagcgatttgagaacatactaatacaatgtctaatttaactaatttgagaacctactagtgttagtagtggctgaggctctcacctccttcaaggctttgctgaattccactctatcactgacacttatcctgagcacctaatttaattctgcagtgtacttctccagctctacctcttccatcttttttttctgttcataagtttattgtctttatctgaaaaatcctcatagaaaattgtttggtttagctctcggcagcccgctcctgagctctgagggagcttgccttctcttgagctacccaatctttcttctgagcaagggatattttgggacagttctacctcttctttttaatttctttcttgggcttcttttcatagactggattctctcgtacagcagcatgagctttcttatacatctcctccatcaagtctggagttacgctgttctttgtgtattgagagaactgttttttggaagcattttcatcttcttctattaagtagcgcaggtcatctgcaaacttctggcccatgatgtgcttccggtgtacttctgcattaaattccttgttttcagaatcataaccaaggattcatttggtactgtgagggatagacaaaccaaggaatcgtttgctactgtgagggttagacaaacctccatccacagctcccttcggggcaccaaacactttattgccagtggtagttctggcaaggtctgcgaccaaatagcaggtaaaggcacctggctgaccatcaatgctttccacattgtattcattgccagtcacctccacttggccttcatagatcttgtccatgcctaacctattgagaagcctgcgggccagcagcaggccagtacaatacgctgcagcataatttgtcaggccggccttcacaccatattttgtgcagactatcatagccccctctatacgggcataagcaacctgacaaatgatatctctatcatcctgtatttgggtgtgttgtatttatttttatactgtatcaccaagcatttctgagcatagtaatcagttttaccctttcatcatcttctaaatttcacttggtaactcttaaagtaggccttattcttaacaattttaacaaaccccatcctgcagaacagagacccacatccgtggctcaacagagaccttcaggcccggccctagtgggggaaaagggcccttttctgtacttttgattccctttaccttgatctacttttttctctttttgaaaacacctattgccttctaaaatactctacaatgaacttacttataatgtttatagtttgaatgtctcccttgctgaatttaagagggaaagggtcttgtgtgttttgtttactgcaatcttttaaacaatgcttggcacatagtaggtgctgagaaatatatttttaataaatgaaaacacttctgaaagaatggtagctgttgtattttggtaacatgaccagtagaggtcatagatgagttctttaattatcttggagctacaactattgtgtctgtttatacaaggatctattcattctagatgtcttggtgatcagtgtggattaccgcacaaacaatttggcggtagtgattagcgtcgatcatgaaaactgcacattaatgatgcctcagattggcttccccttcatatatgacctagtcttgggagccaagctgaaaaaaaaaaaaagaaaagcaaatagaaaacaggatgcaagttagggcagaaagtgttggcttcaaggctatgtctgtctctataaattgcttgtaaatgaaagttaaatttaaataaccagagaagatagtagaatgcttattgtcaattgcaagctatttgtttagattaataatacctcctccccaaagtctgtgtgagtgtgtgaggtggggcaggggaggagtatatactgataaagcctgttaataccaggacacttgactggctttttcctcttcccttttaccacaaaaaacagcagaccacaaatcataagccatgattctgcctgagtgtggtttattctctctggcttgatagctcgtgcctaaatatcacggtatgtaaccacagatatggaggtataaaggaatgatgactttggatcagaagtgaatacttttcttttgattgcatatggattttgatagattgattagttcaaggataaacatttgagaaggaagaaaatgtactttattgattgccccccacacatcaggcactgtgatagctactcttccatgttatctcactccttgaagtgaacaatgtcaaagatagcatctagaacttagtagaagctcaataaattgtcgaatgagtcagtgaacagtaaatgactcttaggaaaaagcatctgtttctctgttttggtttagtttgttgggggggggttgatttgttgcatttttttatgtttatgttcagtgttttatattcattacaggcatccatctcctgggtctgaaaagtaaatagaatgtggtccctgtcacaagacactgaaaggtgggcctggatggagagctaggacgaggggatgttaattctggtcctgctctgaaaattagccattccctttgattatatatgataaatcattacataattcctaccttttctacttcacaacatgtcatgagataaatgtaagatgccatatttgaaaggataaatgcaggggtagattctcttacgggatgatgtagaaagagaatatgccagcttttcaaaaatatctttagtatggggcaggtagggtgggaggatggggaagatcactgttggaagactttcctctaaaagattatggaagttcattctcacactaacagaagtaaaataggatttctttcttcctctcctttttgttttcttcctcgatagcacttagagctttagttggctgtcagacacataatatataaattgcaagcatgatcatcacacagaatgtaaagatgccaagtgtgcatgaacaaattagaggtttcttagtcaaatccaagcaaatatgtacctgataatggctttggctgaaacatatttttatattttatagcatgttcacatttgccagtggttagcaaagattaagcttgccaaactttaatgtggtacaaatgccatgttcaaggcaaagtaagtggactgttacaggatctggcaaatcaaaaacattatcaacagctgtggtttccaaaggttttgtgagactggaataataaagttgtgtgcattttaagtggttattaattttcccattgtttttaaaaatataacttatgatcatgagtagcttcacatggtgttatagttataatcaacttttgattagatgtgataatggccagaaggcaaaaattaattaggtccctaattatttaattaaggatttatagagtgacttctatattcagggtcatgtatttgttactaattgtagccactcacttcacatcccttcccatccttacttttgccagaattgtaataagtgttcatttgaatttcacctatttccattgatcattactagcggacacatctttagatgtgaaaaagtcaaaaggaaggataatgaagaaaaacagtgattctaaattgttaaacaagagacctttgtatagtggaatttagtattatgattctatctgatgttaaaaaccatttgaaaagggacaggagattaacattttgtctaatctagcaacttgaattgaaaaagttttatcatgactatgaccatatatgataccaatcattatcagtatcttggcttttcattttatattttaattgctataattataacgctggacaattaaaaattaccttttcaataaagctggaaacaaaaggaaaaaattgtctatcagagatgatctaaattcacattttctctgtagagtcttggaatttactgttttataaaaagcagtctccaaggattatgttttctctttggatgggtgttggtttcagctaacctcaaggagacttcggtgattcacgattcacctggttttctccataaaataattgggaagaaactgctatgaacctcatgacattaaattggttaagaaaaaaatcttaactattaatatactaagtgtacattttcttaaaaaagtgactttgttagtttcaaatatttttaataacacacttaatgcttatagagttgatttatcaccaatagtgttgcttagtaaatgtcttttgaagatgtttttaatgcaaagataaggattcatctaagatacacaaatctaagttcatacatggactaactcttcaagtcattattgtttttctagaggccaaaaaacttagttggacctatagatatttttattgaaatgaaacagtgttaccaagaaaaattgctttaccatttcagtactttatccagtcttccctaatcagtttagcacattcacttgcatggttgataaagacagcgtttgctaaaaaagttaaaatgaaggtaatctggagaaattattctaaatttgaaatttattttaaactattaataataaaaaaaccttttatttgtatccttattgtgaatacaatactttcatatactataattctctttttttggtcttttatctctttttttttaattttttttttattttttccttatagcattttgttgtgactgtaatacctctgatggaacctgtcttagtccattttctggtgctacaacagagtattacagactgggtagtttataaagaaaagatgtttatttggcttatggttctggagtcagggaagtccaaaggcatagtactagtgtctgctcagccattgatgagggcctccttgttgtgtcatcccatggcagaaagcagaaaggcaagtgacaaatgcaagagaaagagaaagaatagaaaataacttaccctttcatcaggagcacactcccattataactaacccactcccccaacaacagcataaatttattcatgaaggcagagccttcaggacctaattgtctcttaaaggtcccacttgtcaatactcttataatggcaattaaatttcaacatgattttggaggggacagtcaaaccatatcagaaccttaatatacagctcatattgagggaagtttttagggaaaaacttgagcagaccacaaaaacttcagatacataaggacaacataaatggcttatttagccatgctctgtggtgcttcatactattagcatttagctatttggtttactctaatttcttaaaaaaatagaaattgtatttattctcaaaatggcaaaactatgatataaaaatttacaaggcaacaattcagcctgttacaaataattaataccattgtgtgtcaacatgtcacttagaaataaaaaatattattagctgtttcttctaacccacagtagccttattaaaagcagatgatataaaccttggatacatgaggccaggatgcatttgactggcacagatcattgctctaaagagcaactgatgcaggactaccttctggaccatactatatgcaaggccattttctactatactgtgcttaagaaatgtatgaagctaggctgggcgcggtggctcacgcttgtatcccagaactttgggaggccaaggttggtggatctcctgaggtcaggagttagagatcagcctggccaacatggtgaaactctgtctctactaaaaatacaagaattagctgggcatagtggcatgggcctgtaatcccagctactcgggaggctgagacaggataattacttgaacctgggagacagaggttgtggcaagccgagatcgcaccagcttgggtgacagagtgagactccatcttaaaataaaataaaataaaataaaataaaacaaaacaaaataaatgtgtgaagcccatataatgttgaatgactttgtaaacccaagcacaataagatgctatgtagaaattgtcagtcatcatttatttctgccaactttccaagttcctatgccaatcattgggaagaagattacatatacactttatgacttcttagctgacaggaatatgctggtgtggaaatactttcatggttctgtaacatcattggaaaaacttaaggctgagtaatccataagtaaaagtgcattttcacagggcaaaaaaggcagagttaccagtaagttgtcaatttcatgaccaccgttttgcctttttaatttgggtttaggacattcttttcattttccaaaagacttcacatgactaattaggaggattttgccataaactcagaaggcaaagctgttcaaaaagatcactgtatgcttttcttgactttgagtcaacagcaaggaattttctggtccttttaattggtagctggctttccagtagttttccaatgcagtaaacctaattcaccccacttattttaaaagatatccactctgtgtctctcacacatatactggatctcttcctgtgttccctagggggcaggtatgatggactactgtatttccaggcctatagttctttgtgctgttagagctctgtattcttttagtccactggcccagggcccaatgagactctctgatcagcatgagggctggattctgaacattcgttcctgacaccagaatgcctcatcaatcttttatccaataggagccttgccagtgccaattcactcatggaaaaatattagctcatttcttctattcttgtctactgcattcttctccctcccctgctcccatatctccagggacctaagagggtgttccactgattgctataatgatagtaataggcaatatttattgagcacttacaatgggccagacaatccaagaactccacacattgagcaagaatgcttccttaggcctagctgtcaacactcccactgccacttctgtgccatcatgcccatgccatggggggctgaggccccaagctaacagttctcctggggtaagtttgccagatttcacaaatataaatataggaagcccagttacatttgaatttcagagaaacagtggaaaaaatgtatgtcccaaatattgaatgggacatacttataatacaaatcatttatgtttacttgaaatacaaatttaattgggcttcctgttgtttaccttgcagccctgtttggtactgtctgtactacatctgtagaagtgagccacaaaccccaatgtgcccaggtttctcctcattcatccggatgtttgaggttgggtcccaggaaatgaagcagagaaaaaaaacactggtgtctgatttcctcttctcctcccctccccgacttcttgtactttcaactccatccaccacatatctgtgtccctactccaggtgtaagtagatgcccagtatacataaaatctgtgatctagtcagccagtcctatttatttttattttattgagacagggtctttctctgttgcccaggctggagtgcagtggcacgatcatggctcaatgcagcctcaactaggctcaagcgatcctcccatctcagcctgtctagtagctggaagtacatgtgtgctcctccacacccagctaacttttaaaaaattagtacttgtggagacaagttctcactgtgtttcccatgctggtcttgaactcctgggctcaagcagtccttctgccttggcctcctaaagtgctgggattacagatgtgaggcaccttacctggcatcaagaattattttcttgctgttgatttggaaagcttatttggatgccagaaactaaatattaactcttttgcattcctattgctttactttgatctctccctggtacccttgcagatcaatggctctctggctaataagataccaagaaatgcaaaagagaaatgcatactgatgtatttgtgaggaggaggattttgcaaattaaattatatgcatgttttagcattgtctgtcttccccttttttaccaccctaatctagaatttaatcttcatgagcatatagaccctaacctgggaatgctaaaacagggccaggcactgcctagtaaaaatgtgttgagtgacttttccagtgaggaaaatgagacttaggaggttagtttgccccatttgcaccccagagctgggcttcacatgttgatctgactaattcgtgagccctggcacatcactggtatgtatttctgcctatctgctgtctagcagttcatacagtttgtgtgtggtatgtttttcctcttgaagtttggtttcagtgtggaaaaagcaaaaacaagaaatacatttcttctttagctcaacaaaagggatttttcaacactagcaacaaaaggtaaaggaaaaactgaagaaaaacaaaaagaatctcaaaagcacagaaccatcatgtttataaaatactgctttctaattgtacaatgaccaaagatctttttattctgcatcttgtctgagagtccaatgcgaatgccgtgatcttgagataataatttcttgcatagggccacacatagcctatgggaagaggcaccttttgctggtcagacatggtgcagctccatggcacacagcctggtaggaggagcgcagactgaatcttagctgcacttgctgctctggccaggcaccctcatggactggacagcccacacctctataagtaatggccttttcttggcatatctggccctccttctctgaggtagtgggagttaggactctaacatatgtttttgctggggacacaattcaacttatagcaggttgctaaaagagttaagtatggtaacttatatgaagcaccaaacagaaatcctggaatataagaactacttaatacttagcagatattatagttattaatgatttgtcctctgctcttttggaatggttactttgggattaaatggacatatgtatagacgacctatgcatatgtataaataaaagtgtgtaaatatcagaaaatgttagacacaagaatcaattattgaagatcaaagagagactttatgcatatgtttggggtggaggggtggaacagagcagggatacaggatagatggtgaatacatgtgatagaatgtgtccggattgactgattttgggttaacactccatttaacttcactttggaaacaggtcaaagggagacagaaagggaatcacaatttaccccttaacaatataattcatgtcagaaatagtcagaacttttttctttgattttgatgacagaaaaactcaaactataattattcaacaaacagcattgctggggaaacgtttactggagtaacagtttgaagcctctgtggggtttaaaatggtacactttctgtggcaccttaggcttccatgtgttatttgaagagaaattctcactgttaatgtaaccagaaagaagaaaattatatttgttaggttatgaagagagacatattatttgatcttgaactctccccttcaggacatccttcatggaggctgtacacctaagacaatgaaatggaatgcatgaaaaagaggggagccttcaataacaggagggttgtttgtaagaatctgatctccattaagaatagggccagaggaaatacatttgaattgcagaaggaagaatttaggctagatccaaatgctctctgactgcatgggtaaccagtgaaataggtgcccaccatctattatgtggtggatgtaaccagtacattagttgtaaaatagaggctaaacaatacctttttaagggagatctgtaaaattttgatagaaatagcattgctaaaattcaaaaatcataaggccttctgaatattctaaccaacatgtaaatttgcattcccttactcacttttccaagatcactcttaatttttttctaaataatccctctaattattattactcaattcagtaatatagtatacttttaaaaaatgtattgttgggtttgactaaattgatcaaattgaaagttaattttggtgttgtaaagacatgatcttgtaatgttcccactcaaagatgtctattaaagtcataccaaagaaaaatagaaaatggaaagaagaattccaaatattagaattaagatctaaatcctgatttccccagggacagctggatttctttgagaatgagttgttccattctttttatttttgcaaaactgatttcaaggaacctttctagtaagaaaccattcttgttttgttttggaaggtatgagaaaaaaaattttttttttgagacaaagtcttgttctgtcacccaggttggagtgcagtggtgccatcatagcttaccatagcttcaaactttcaaactcttgggctcaagcaatcctctcactttagcctcctaagtagttgggatgataggtccataccaccatgcctggctaattttattttattttttatgtagagacagggtcttgctatgttgcgcagcctggtctcaaactcctggcatcaagtgatcttcctaccttagcttcccaaagcttgtgattataggaatgagccactgaacccatcctgagaaaattttgaaccttgttcgtgaggggtgagcagaaggaggagctgctctctccatatggattgtattgtcgattgagacaggcacataattgcacaaattttcttttcactttgcctaagaagacattttcaatgtaagtctataaggaatcaaacgtggttatcaaaccagtccacttccagaagggactccatatccaaaggaatcctgacatataataagaacaaaaatgttcaaagtataacattagccttgatttctagcaatgttgccaagttcatctgaaagctctgttactataaatcacttagataagctaaaatataataagcatgcttttaaatgctacaaagaaagtaaggaaaataccctgcaaactgatcttttgatggctatgggtttttttttttgtcagtataattaacaatgggtttggattttaatggccatgaaagtacaagagacaaatctttgggcccatgaaaggcagaaatttaggcctaagacccttaaataaagaacttttgaattactgtagatctgtgaagcgggggaactgaaaatgtttatcttctcccagtaggagacaaacttttgtgcttggcctgatctactaggaaaagaggaagcaaaggaaaatcctgaggatattagaaaacctgaaccctaggctgctctcactcaggtttagggtttgagtttttactatctggatgacacctaggttctccacaaaataatgtaaaaagcattctcaggttgataacaatactggtgccccctaatatgagtgactaaaagccttctctaggaagacctattttcaacctaggttgcacaggagtcctataggtaatgtgccacccaacatgaactcacaattctaaattacaaaatacaggaaaggcagggcatgctggcatatgcctgtaatcccagcactttaggaggcccaggcaggaggatcacttgagcccaggagtttgagacctgcctgggcaacatactgaaacatgtagagacagcaacatgctgtctccacaaaaaatacaaaaattagccaggtatggtggcatgcacctgtagtcccagctacttgggaggctgaagtgagagaatcacctaagcctgggaggtagatgctatggtaagccatgatcatgccactgtactccagcctgggtgacagagtgagaccctgtctcaaaaaaaaaaaaaaaaaaaaaaaaagagagagagagaggagagaaaatacagggaaaaacaatctatagtcatcagaaaaaacagccactataattagatcctcatttagaaagagactagaaaatagtatgtttacaaaggtgaaaataatagacagtggggactccaaaagggcaagatttgaaaaacttcctaaactacctagtgggtacaatgttcatgatttggatcatgggttcagtagaagcccaaaccccagcatgatgcagtaccaccatgtgacaaacttgcacgggtaccactggaatctaaaataatttttaaaaagaaaagaagtatgtttaaaattgttaaagagaaaaggcaaacagagttctgctgatgggcaaaggggtactgcatgttatttgggggaccacttcctgtggcataggctggggttcaagcaggggaactgagcatgggagtgggcagggctcctggcctttgactgtggaccagcgggcaaagggaagtttcagtctgtactccagctgaaagtgagtttggaaagcagactgattaattccaaaagggtagaaacagcaagaacccaatgaaagtgaagcatgacaaacccaatgaatttagaaggtggaagatgtggtgtgtactctaaggcaaaaatacacaaatataagtacctgtttataagtcacctttagagaagtctgtgattggaagcttgctggggcaatagtcagaggtattgctttgcctgtaaagtgaagccagatccaataaaagagactatgctggggcattaatagcaaatttcaatgccttgaaccatagatatttaactagagttggtttctctcatccctgccccaggaatgtctgccctttgttatgtgagtataagaggcaaaacttccagggtcttctgtctgatcatcttcccaatgaatgggacagaaagtttcttagcactagaattgggccttgatgttttatcatagtatgaattagtgtcatgccaggtctgtaggtaatacatcaccatgcaaggaggtgtgttgaagacatgtgatggttactttcatctacattcaactgtttggaactttttggtacctgttttttgataaggaatggaatagtcaattaaataaataaaatcaattcaaactgtttgcttaagaaacttccagatttccagataggaatcacttgtcttcacggacaaaatccaacttagaggtaaaagccagattagcataacttgatgaggatccatatagtggttgcacattgtgatgttgtcaaatgaagcattctagttgagtaggaagaatttagagccagtatcatgggatctggaaaatcagccagcagtaatttttccctccctccctccctctttctatctactttacaggtccttctttcctttcttccttctttccttccttccttattccctttctttcttccttccttccttcctccccccctccctccctccttcccttccttccttccttccttcctctttcatgtttcctgacatctataaaagggagattcctcttcctcttcctccccttactcctccttctcctccctctcctcccttccttctcctccttcttcctcctctcctgtctctccccactccctccatcccggtcattccttttctctcagtatctgtctttgtggataactctttctacccactttctacccattcgccggtatctgctgaatgctggcctcagcccatgtgtctacatgaccttccagcccagctccccagagtttaccgtgtgccacactctaggtttcggttctgtcaggtgcctcctcctgtctgaggcaggcatggagggagtggaaactagtcatagtcctaaaatgtatagaaagggagagagtagagtttctttttaccttcttgagtagaaatacagccactctttgctctgcaggataattttcaagctaccctatatgtttaaggcagctgggcatctcagagtgctgtgtgatttatttgtacagattcacgtaacactaccctgttctcttagatttggttgaagctggtggtctttgttatagcttgtggttcatgatttatctgaggattacatgaggaattttttctctaatggtgtggtaaagggcagaggaggatctcccttttacagatatcagaaagcatgaaaaaaatagaattggatttaatgctttgcagatattctgtttttcttcccaattatttgatttcacctatatacatattcttttctctttttcctagctttagaagcaaaccaacaaaagcagtttggactttagtaacttttttttacagcagcatttagaacagtttgcatgttctgaggaatattatatgtgtgttggggggaaaggaattcacactgaataaattttagaaataattaaacaaaataaagcaagttcctttactgcaagacttctctgatcctttaatatactaatagactttgtgatactccaaattgtaaagatagttctcccaaacttatttgaccttccaaaaaacatagtcatgaaaacagaagcttttaagcttgttgtgtttaccaatgcaagttctgctgctcttctgacccaagagattgtctgatcctgtgctggattaatctcagtgacatagcccgccctgtacactctgctgtgtgatgcaggggccaagactctgaaaagtgcatttcgctctggtctgtgagcttcctcttaggatgccctatagggactctggactgcaggaggagggatggggatttcccttctttctgtttgcttgctgtttctaggtgtcaccctatcagtggcctttctctgggcagcactagtcatcttctgtcttcagcttctttccttgctcttagaacctcactgcaatctgtctgaaggagcagtggactccagctagtgcctctgtcggaggtcagagccccagatccaggaaacctgtcctacaagctcctgatgtatcaggaatgacttggcagtggccccacctcaagacatgggtccctactctatgaggctctcatctaacttacagttctggaaactccaacctcttccctaagagtggtagttgcttcttacttatctctgttatcttagtgcctctttgctttttagcctttcaacatctgtaataaacttcccatatcaaattccctctgttaaaatacctagtgtggtgtccattttctcgaccggacctcgatggaaaagaatgcagtcctccaagggagtggctctgagatggggccagggtgggaaggtgggtagaggagacagtggaggagaagccttgaattctttccttgaatctaaagcagtgtttttcaaatgttagaaatttaaggaactcagaggaatttcatttcaaaaattttacaatatcccttgagataataggatatgatctggggggtggtaaaaagtagaattattaatttctttttgatttaaggtgttatgttattgcacaagtttagtaaaaagggaactaaaggaatcctttctcaggcctctatttgccacaactgtaaaccacatatttgaagaaaggggaaggagatcgtgtgacttggtaaagtattggaatcaggagtgaagtgcaagcaatacgttctaaatggaatttccaaagatacattttaaaatatttggtttaataaataactaaattgccgggcgtggtggctcacgcctgtaatcctagcactttgggaggcctaggcgggtggattatctgaggtcaggagttcgataccatcctggccaacatgatgaaaccctgtatctactaaaaatacaaacaattagccgggtgtcgtggtgacgcctgtaattccagctacttggggggctgaggcaggagaattgctcgaacctgggaggcggaggttgcagtgagccaagatcgtgccacggcactctagcctgggcaacagagtgagactccgtctctaaataaataaataaatataaaaaataactaaattaagtctcaggttcgtaaatattagtgatcattaggatcatctggggagcactaaaactccacattgctgagtttgatcccaggcccaggggttcaggctggggtcttagttgagatgctaggattgggatcctaggaattgatattttttgaaaaaccaccttatgcgatcaaagaaatccaatgattaacagatttaggattcactattatatagaataaaaatcttttaattataaatgcatatatatctatgtgtgtgtgtgtgtgtgtgtgtgtgtgtgtgtgtgtttaaagaacttagattcaacttcccctccaccaccacttaaagtatgaggagctaggagcaatacagtgttgacagtccctatcctggcagggggcagttgggaaaacactggattagaaaagatgaaagacaatggagcttccctaggagactgatttttgaagggcttttgatcatcctccacccagtgtcaaagccagtcatgaatcctcagaaccaaggaggtcctggcaagttctgttgtggttacccgtcggacatccctgtctggtcaccggggctccgaggggtgccctgctctcaggatgctgggatatgagtgtctaaagtgggcctttcactcatcagtgattttcccaggctgttacctgtgtgtgagtctgagatacagtgaccaggcaggtgacttcaaaactgtccacagagactgccaggggcttgtcaggtgaatggaaaatgaaataaatataagaacatcgccaaggtaggcagcaagaaagagtagaatttaaacttagtcagagtccattttttttgctttgtgactttgaaatgaaatacagagcaaaggagagtcttgaggttttttaaacactcttgtgaaaggggaaaagggtgtttccctggcactgctggtgcagacctgtcttgtcgccatgcctctcaaaattaagaaaatcaaggactttctgctcacagacaaaaggatgccaaataactcaggatcaagaaatataagaataatgtgaatttacaagttcagtgcaacagatacctttataacttggtcatcacaaagagaaggcagagaaactgaagcagcccctgcccccagttttggcagtgaaacagctggaatacactggcacaatgatttaactatattaaaattctttttaactcaaacaacaaaattaattatttcaattaaaaggatgaaaaaaactcctcgttttctaattgattcagtcagccaatcgcctggtggagtctggtttgggttatatcattgggttagttcgtgttacttagtgttctggatttgatcaggaaatccaccaggcgtgtggcttttcagtagtggaatcttgttggcaggaaaagtcctcagcacactgggtgattcaagtgcactttcataatttgctcttgctttaccctctttgttatgtccacattccacacgaatccatcacttctctctgagttatgtgctgctcaggactgatgctcttaccacccacccagtcagagcagcctctgcttctcaaactcgcagaacctgttgttctgtccctctcttacctagtgctgtcactgtagccttttacctccagccgggggcagggaaatgactccccagagagccatttctcatggtcataaatgttctattttactaagttccatcaacattcaccaaacactgaagcaaaacaatcgttctctatgggttctttttttttggtataaacatatatactgcccattaaagtgcataagctatttgtgtatgtgggatgggtaaattggaagccatgtcagcatctgtacacaaatcatttgtgtgtgttgtagggtacgtttacctgtttttcagtaagggagtaagacaccttcatgcctggctgaaccaccaacttcgcaggcttcgtgtagacactacaactgtttatgtgtttggattttcactaattactcctctccagttttttcccctggtgtcccaggtgtgttgattttaattgcttcactcatttaagcatctccccagactgtaatagattagttagccgtccaagcctgctgctggctttcccctctccccttctcatttgcttccatacccaaaataaccagaaacattcattgctcagtaatgaggctgcaattcttctctgcggaatccaggaagacataaaaggcagtctctatgttaacatcaactcctgctttcctcgtctttgttctattatacgctctctgctgactaactttagagaagaagcaaatgttaccccaccttaccagagcatgaagttgtgttactgagcaatcttagggcaatttactatgtaagacactcaaaacaaaccaaaatagacacatacacacacacacacgcacagagtaggtcaaaacaaaacagtgtgggcatcctttctaatttttcaaacctcacctgctgaatagcatatttaataaagcacataccacttatttgatctggcagtacttaacgcaataacttacacacaaagaaaggcccaaacatttagccacaggatgtcatcaaataagggaagaaggtttgtaataatggtttgtaattaatgtttaggttttaagagatgccttaagaaaaacaaaaggtcttattaactcatttgccctcctaaataactctatttttcaattgactgagcaaacacccaattagagtggtaatttattagggtcatacattagctgaaaagaaaacagaaaaaaagaaaagctgtatcagaagctagaattaccaaaggctgatcttgtttgagttcatatatggtatcttttaagcaggctgatgacaatctttcctttatatattaaagataaacaatttagacatagtccccgcctggctaccttaatcttaattgcaggaaaagacagtatagaaacacggatttaaaaacagcagcaacaataaaatgaaaaaacataggcagtgccaagatgcacaaagagagaacggtttcaaatatcacactgaacttagctttccttcagttgatccataaggcctgctataccacatcattccaagaaacaccaagactttgtagctttgctatggacactatcagaaaggtcagttggtttgatcaaaattgtggttgtgtagcttcagccattctcatagcaaaaattggtaacctaaggttgacaactaagttttttattttttaattaattaatttatttattttggagacagggtctcacgcgtgttgcacaggctggagtgcagtggcatgatctgggctcactgcagtattgactttctgggctcaggtgattctcctacttcagcttccagagtaactgggactacaggcctctgctaccatgcccagctaatttttttttttgtatttttttgtagagatgggctttctccatgttgctcaggctggtctcgaaatcccgggctcaagctatctgcccacctcagcctcccaaattgctgggataacaggcgtaagccactctgtctgaccaactaagctttttataagggagcctgcagtttcaactaaatctcaattaaaattgctgtcatctgttatatttatattattttaaattttaaactttgattggaaatgagattttttgataaaataatgaactctgagcaacatattgatcaatcaatgactaatatattaatcatgagtttcttaataacaaacattgagaagaaagttagaaaaataccatcgaaatgtttgatgggattctaaatatttgcaggccctgtttttatcaaagttcacatttttcaataaatcttttttttaattcagttttttttttctttcaactattgcttttgggacttaatagatttacctaattcttgcaaagcttgatcatgatatttcacttctttctatttaagacttcataaaaaattgagatgttgtagtggacaataattatcgtagataataaaacagagaccgtgttggctgttcaccaaactgggttcctcttcttcctggacacctacatggtttccaaggaacggttccaattagaagtggccatgagactgagtcctggtgcatggaatgtgtgcagatgtgatgtatacacttctggggctgtcctcttatgagcctcccaggagtgattatccacgtgctttctttcctcttcttccagtttaatgcaaataagttcaggccccttggaaacagttgaaaatggcagagtcacaagatggaaggaacctgggtcccaaaacattactgcttgaaagaacacttccaacgagtcaggaatacccatttaaatgatccaagaataaacttttttgtgtgttaaagatttttgggcctataatcccagcactttgggatgccgctgtggaaggatcagttgagtccaggggtttgagatgagcctggccatcataggcagactctgtctctacaaattttaaaaaactagtcaattacagtggaggacacctgtggtcccagctacttgggaggagatcacttgggcctgagaggtcaaggctgcagtgagccttgattgtaccactgcactccagcctgggcaacagagagagaccctgtttaaaaaaaaaaaagattttttaatatacatgcattatacacatatatgtatcatatacaatacaaatatataaaaatatacattattatataatttcaaaaattattataaatatgtaattgcaaaaatacagaaaactatatttagatatataaaagttttcttatttggggcaaatacatggagacatgtcctcccctcttaccacgataggtaaaggtggatagataattcttgtcccttctctctggcaaaagcacgggcatgtggcctgactcaaccaattagatgttcctgccagatacttgagggacttgagggaatgatgtgcttaatgattcttccttctttgttttgaacaaggacacgtcacactgtcttcatggaaattattttcctcttaggttgtaataggggtatttcttttgcagctctaaatccaactagtcaacttgtgaacatctctaggtgaagcttcagagaagtctttctgacatgtcagctgtatttctgcaaaaatatggtgatatttctgtcaaaattagttttatggtgtatttaagcaaactcagtttctctctattttcactgcctggcaaatgagaagcgctacaggtttctttttgtttgtttttcacacacaactgcttaggggagtggttagcagtatgtttaccgtaaagaatttcatttctaacttttgctctctacagaatctgtgtggattgaaaggtttttcatttactaaaggctttacaaagtagtaataaatttgcttttccatattttgttacttctctcctactcctcaccatggaatatgtaggctaattctaggggaatgggcacggctttgacatgggttagtgggaatttgaaattttggcaggcatggcaaatttgaattttgttggacatttggaattgccagtcctggcttgattggtttactttaataacatttattttgacagatagtgtgttaggtgctgaggacacagaaattagtaagctatgcttttctctccaagaagtcataatctgggaacggagacatatacacgaaaagacatatccaatatggtgtggcagtgttgggcataggtggatgtaagaggagagggctctctactcatttcctagggctgctgtatcacatcactacaaaccaagtagcagaaatgtatgctctcatagttctggagactggaagttcaaaatcaaggtgtcaacagggccacctttcccctgaaatctctaaggaagcatccttcctccatcttctagcctctggtagctgctgagaatctctggcattctttggcctgtagatgcatcactccaatctctaccttcatcttcatatggctttctcttctgtgtgtgtccaaatttccccttccttagaaggacaccagtcgtactgaatttggtacccaccctaatccagtatgatctaatcttaacttgattcggtctgaaagtactcatttccaaataaggtcacctccacagtttcccggtagacattaatttgggggtgggtggggggactattcaaagcagtatagggcattgagttcagatgagggcaagtcagaaagatgatcaaaggatgtttcctagaaaagaagctgagctgtatcctgaagggtaaatgaaagttaaaagagaaataagatggttcatcacccaaacatgtgtgatacatgtaaaggaggctaaaaacaccttctacacacaaaattttattgtgtcacttattttagttaacagtaggttcagtctcaaacatttactttgtctttttcctgtggcaaagtctccgtcacggctctaatccaggcgatcctactgtagtctcagctgtgaaatatttagaatccatgtgctaaatatatatcgcattaacacttcctggtgccaaagtctctctgtaatcccaccccctctgtcctgattctaactgtgaacatggaacacctgtagacctcttatttttctctaattttgggtctgggactacttttgctcataaaaagtataaaggatcactgtattaggatcagaactaacttcatttattcagtcaagtcattcattaattccataaactttgttgagtattaactatgtgtaaaccactgtgctagatgtgaggcaattaagaagatgaatacaatataagtcttgtcctcaaaaagtctgtagtctaggctgggtgcagtggctcacacctgtgatcccaatgctttggaaggctgaagcaggaggatcacttgagcccaaccaggagttcaaggctgcagtgagctatgatcatgccactgcactccagcctgagcaatacagcaagaccctgtctctcaatttaaaaaataaagtctgcggtctaataagggaaagcaaaacaagtaatatacatgatagaccgtaaaatccatagcaaaggagacgatgttgaccttgtttatggctctatcccacacaaagttcaacttttggctcacaataattactcaagaaatagttactgaattgaataaaaaggtttaaacattatcgggcaggaagaaatatttcggatcttaaattccctgacagctgcactctgggaacttgcctgcctagatctctaaaatgtacttatttttcaggcctttgattcattctcagctttgaaatttaatatttaatcttgttgggatctctgctgccttgccttatttctgctagaaagaagatcctcatctatattttaggtttagagtgaagacgtgcaacttcctaggagcaaccatgtctctgatgtgcctcttagagcttcctgctaatggcttgagtgagagtcactgctggggcaaatacattcgggatcatgtgacggaacagatgatgcaggacctttctcttttcttcaaacgacttcagctgctccctgtctagttctcatctcatggaactcacgagatatctggagtcatcacctaacgttcaaacttagtgttctgaggagtcctgtagagcagatgggataggaatttgaagagcatgtctccatgtttttctatccatttgtcttagtctgttttctgatgctataatagaacaccacagactgagtaatttgtaaagaacagaagtttacttggctcgcagttctagaggctggaaaatccaatatcaaagggccgcatctggtgagggccttcttgctgtgtcatatcatcgtggaagggcaagtgaggacgtgggacaaagagaaatggggtctgaactttatcctttgatcaggagcccacccctgaggtaattaacacactggcattaatctactcatgaggtcagggtcctcacaacctaatcacctcttaagggccccatctcccaatccattacacaggcaattaaatttcaacatgagttttagaggggacattcaaagcatagccccattcagtacttatctttcagtgcaatgcttgggggcataatagtgcacatttgaagtatgaggttaggaaagtacctaaaagtggtagttttgaggataacaagtagacacagattcctttctagttaactcgaggattttctattctctttaatgcatatcctcctgactggagtgaggcttctagttttaccttctaccatgaatgcttttcagatcttatgagatccatgtaagacattctaataggtggaaaggagagaaaaatatcacagaatagaaaggaaatgatgagagacttgtatcaacaaagctggacaacaaagataaaatttgtacatttttatctagaatgagcccttgtattatgcaatgattaaggttaaagaagacataagaaagcctgggggaaaacagggcctgtaatactgtaatagtgtccatgaacagaaagatgccaaacaaccccttggcatgttgctcacctgcctgtcaatagaaaacactaaaacacaaggaagctaagtcaaaacagaccagcattctgtataggtgtctcatgaaacattttgggggagaatttgtatactttgaaaatattatcgctttgcctttattgatcacttttctttggaatttttttctttaagagaaggggtcttgctatgttgtccaggctggtcttgaactgaaaatatttttgccttgcctttattgatcactttctgttctgaattcttttctttttaagagaaggggtcttgttatgtttctcggttgctcttgaactcctgagctcaaacagtcctccacctcagccttctgaatacctgggactataggcttgcgtcactatacttggattcttctgcatttttatggcacttgcaatctttgccacatagtttatatgttcaggaccgtgtcatatatactgttagctttatcttaacatttcaagggcaaagagcttgttttgtgtgtgtgtgtgtgtgtgtgtgtgtgtgtgtgtgtgtgtgtgtttgagatggagttttactctcgtcacccaggctggagtgcaatggtgtgatctcggctcactgcgaactctgccttccagtttcaagagattctactgtctcagcctctgaagtagctgggattacaggtgcccgccaccacgcctggctaatttttgtatttttagtagagatgagatttcaccatgttggccaggctggtctgaaactcctgacctcgggtgattcacccgcctcggcctcccaaagtgctgggattacaggcatgagcctctgcgcctggccaagagcttgctttttttagaaccactctatcttgtagtagtcattgtggttgacttgtcatcatctattcttccctgaatgtaattctgtacaccaatggtcagcaaacattttccataaaggacatagtgcatatttaggctttgcaggcacatgatctctgttacaaccattgtactgtgcagttgcatgagaaagcagccacagacaatatataaatgaatgggtatggctgtgttacaataaaactttatttacaacaataggctgtgggccggctttggcctttggttgtagttttctgatttctggtttctgatttctgctggtcatactatttccctcaacagtgacttggtcaaaatggcacgtgcatgtgacccaatcttggtcaaggaaacatgaaggaaatctagtggggacctctaggaaaggtttccttaattctaaagagatgcagttagagcctctcccttgtttttctctggatcttgttgtggtgggagcaggcattttgccacctacctgaggcagacaacaggctgagagaatctccgagaagagagagaccctgacctacatgacctggagcccactctgtcctggtctccaagctatggaaattaataaatgtccttctgtgtaaatcatttagtcttttttttccttccaagaaagcgtaataattgatactattgtattcctgaaagaagatgttaaaatgataccaaaatgatataagttgagtttggcttctctatggggcaaagtaatatgctttgaattacatttctgataaagaatacagtgcccaacttttaacagaaatgataaaaaaagccatgtcaaatcagctacatttatataaagtttttatagtacatagaaattgatgaattagagcaatataattagctactccaaactgaaattaatatgtatatgtatattatatgaagttcttatcttacatcttcataatttctacattgttttaccacagaaaatatagaaaatactcatgcaaggccgggcgcgatggctcatgcctgtaatcccagcattttgtgaggctgaggcaggtggatcacaaggtcaggagttcaagaccagcctggcccaaatggtgaaacccccgcctctactaaatatacaaaaattagctgggtgtggtggcaggcgcctgtaatcccagctacttgggaggctgaggcaggagaatcgcttgaacccgggaggtggaggttgtggtgagccgatatcgtgccactgcactccagcctgggtgacagagtaagactccgtctcggaaaaaaaaaagaaaagaaaatactcatgcaagtcactgaatccattaggattttaggggacattttcacaagactctttaaggatattttttttttttttgagatggagtcttgctctgtcttctaggccggagtgcagtggcgggatctcggctcactgcaacctccacttcctgggttcaagcgattctcctgtctcagcctcctgagtagctgggactacaggtgcacgccaccatgcctggttaatttttgtatttttagtagagacgaggtttcaccatgttggccaggctggtctcgaactcctgaccttgtgatccacccacttcggcctctcaaagcgctgggattacaggcatgagccactgcacctggcctttaaggagacttttaaggagatttgggttcacacgataagttcttgagacatcattcagtccccctcccactttttaatgaagacacttccaggtatatttatttgttcatttttttaaaactacaaaaatcataaaggatcaaatgatacagaattataagataatggtttcccttttgtgcccctgaggatgctaatattcatttattttctttatgatgaccctgcttccaacataagcattaagtttcagagggtctataaggtcaaaaccatttttgtaataatatatatttgcctttttcatttggttgatgtttgcattttgatggtgcaaaagcaatgctggttaaaactgctggcactttagcatgaaacaaggcaatgacacctaactctactaatagtcattgtattctttgatgtcatgcactcacggggggaaaagccaattttaatgaagaatggtcttgaaagaatcaataaaattattactattattaaatctcaactttaaatatatatatgttttggttttggaggaggagttgggggtaggatttgaagccagaaggtttctcagttagtcaagttacctcactcagtttccatacccataaacattagaaaaggaaagcaaaatatagaactctgcacaaatttgcatatcatctttgtgcagggggcctgcttgtctgcgtcattccaattttagtataagtgctgctgaagcaagcacagtgtacatgtttttaatattctgtgacacaaaatgagaagcacatataaagtacttctgctatgcaccaaagcaagacagttgttagatggataagaacttttgtaattatttgtgttatgagcttaacaagcctcatttttttcatagactgccatctttacttgaaagaatgactgacggactatggttaatttggattgaattttggcagatattttctctaaaatgaaccatgtgagacagtcacttcaaggaatgttgccagtgataaaatcttgagtttacaagtgaaaatatgaattttagaaaatttttatctgccactgtgagcttcatagcttctgtcttaggcagttcaggctgccataacaaattgccataggtcaggtggcttaacaacaaacatttatttctcacagtgctggaggctggaagtccacgatcagggtgttagcatggcagggtttttgatgagagttcttttcctgatttatagacagccatcttcttgctgtgtcctcacatggtgaaaagagggctagctagctttctggtctcttcccataatgccactaatcccatttatgagcgttccacctcatatcctaactatctcccaaagaccccacctccaaataccatcacactgggattaggatttgaacatgtaaatttcaggaagacacaaacattcagtccatcgcagcttcccaatacttagagacattttggatgagatcagtggtattgttattaatgattgtgattgtaatatgtcaacatttgtgcaagatggatccatggattttaatgaaacaggaacgcaaaattcactgattagttttcagatatcacattgtaaataaggcttaacaaactaccacatttcaaattgttgtgcatatcaaagaagaatagcttcaattatctgaacaagacaatcaggatctggccgggcatggtggctcacttttagtttccaattttagtataagtgctgctgaagtaagcacagtgtacatgtttttaatattctgtgacacaaaatgagaagcacatataaagtacttctgctgtgtaccaaagcatgacagttgtcaggaggataagaacttttgtagttatttgtgttaatctctgtaatcctagcactttgggaggccgaggcaggcgaatcacctgaggtcaggagttagagaccagcctggacaatatggtaaaactctgtctctactaaaaatacaaaattagctgggcatggtggcatgcatctgtaatcccatctacttgggagactgaggcaggagaatcacttgaaccagggaggcagaggttcctgtgagccaagatcgtgccactgcactccagcctgggcaacaagagggaaactctgtctcaaaaaccaaccaaccaaacaaaccaaaaaaacccatcaggatggggggtcaccttatcctacagtgacccaacttataataatgcaacttcttttcattttattttgctctggcttctgtagccaagtctataaactcaaggccaactggagttggaatgaggcatctgctggcctggccatctgccatgctcttgagcatctttgtgctacagacaaacaaaccagaacaaagggattcactgcagagagacagtgctccaaccctatgacatggctatcattgccccacgaaagccttaggatcctggcttacccatccgctcttgttgaagaaggattgcttttcagtttaagtcattacttctgttttgctctagtacttacagaaagagaaccgacaagcctgaaatgacccttctgtgaacaaggttttacactgggatttgaaataccggaaaagttgtgtccctagaaaagtaactctagccttaacatcagcaaaatgaggatttatttttatttttatttatttttgcattcagagaggaatgatgatgtcatccatgtccttacacacatcttaatttgtggattttttcttacttaactctcttaattggatgaaagtatgcagctgatgatttatggatcgctagttgtgccaggcatctttttaaatatgcacagctgctctgcagtagtttaacttggcagatagtattaaaccattgagttgtgtcatttatttgtacatgcatacaatagcctccttgtacaggttcttccaaaatctctacaggaatggtttaggaccatgcatttaaagagtctcagaaagtattcttttggaagattttcagtttccagaataaagaatgagatagcattttgcgatgttgctaagttcccaagggaatcacagagacaggctgaagtggagaggctaacagagtgagaggtctccagtgtacatttgggaactccaatttcagtggtcgtttaggcaatgtaggacgtgttactgctgacaacactctcactttcactataacacatctcagggaagcagctgaaagaggtgggtgatctaatacaagttgttgcaggcataaataacttgagaagctctgttgacaataaaagtctggcattcacagtagtgaacaatgttatcttcaaattcaaaggaccctgagatttgtcactgtcatcctttgtagtcaaggatgatactgttgacactctggctatccctgtatgtaagtgtggctgaaaatacccgaatgtgacagatgataagggctttctgcagagcatacatgataaatcttttttttttttttttttttggtttgtatctcctggtctcccagggcatagctggccttgtcacaaagtcatcgtgtctgtctgcagcagaacctgctgctctggcactggcctcttggctcttgcattccaaaaacgtggcttgaatagctagaatgtctctctcctgaactattatgaagattacacctcctacctgatctgcttactatcccccatgccaaagcaagccaggcacatgccacagttccttcccatgctgtgacttctgtgagaattatgttgaggtgggcagtatttctcaatagcttcattcactggtgattttattctgccatttgacatttttgagtgttctcaactggaaacatcttaggtgctgagataattcctcctgcacgccccttctcagttttgcctgacccaggaataggaataggaaaagcagaggagctgagatatgcctctcctgtaggtggaatagtctgacattatacagtttgttgaggaaaaacaactgtttaaactgattaaaaaattgtttccatatcaggctggtattagactgttttcacactggtataaagacatacctaaaactgggtgatttataaaggaaagaggtttaattgactcacagttctgcatagctggggaggcctcaggaaacttacagtcatggtgaaaagtgaaggggaagcaggcaactcttcaccaggtggcagggaagaaagcaagcacaggggaaattgccacttataaaaccatcagatctcatgagaacttgctcactatcatgagtaaaccatgagggaaaccgcccccatgatccaatcatctcccaccaggtctttcctttgacattacaattccagatgagatttgggtggggacacagagccaaatcatatcaagcctgtactccagatattttttttaaagctgaaagtccccaaaagctcatctctggagcctgatcctgggcgttcctgagccactgcaaatatcttagagagcctttctgtgctagtggctcagatgactcatattgggcagtgattagttgagagcatgggcagcattgggatctcatgctgatagcaagcactgctagcagttggttactttgcctctttggcttttacctgtgggttcaggatggggattatgaaggctattaaaagggctccttgacggtcccttagtcttaaaacctcctgcaggaggaactgcagattctctcagactctcagatagggaaacccaaaaagccttattagcgatttaacctttgagtaaattgccttatcagctcttctttgagaagaccctcaactaagagtagttccacgcataacaaagctgtgatgaggttagctgagacataagagggatgagaagcgagacccagtctgggtcactgggcctccccagaggggaaaggcctgacccagggcatccacgagcagcaaagggatacttggtgtccaagaaagaacacccaaccaggagagagaagggggacctgaaagtaggaagggggaggagctaaagacgtactttgtccacatcacaattttgcctctctttggtttgaggttatccagtatagtcctatctgacataatttttgaagtcgtttctccaaggaatgtctctgaatcagctttaagctctctttggtcctccaaggacactagaagtcaggcagagattccttaagatccagtgtatatatcaacagcctctgatctcctagttatcctgtttttttgagaagagctaagaggaaaaggaataagggtaagccagcatctagtatgaggaatgctttgttattcccataatatagataaggaaactgaagtttagttattgaaccaggagcacctaagagctaagaagcaaagctgaaattgaaactgagacctatctgctgaggtgagcagctccgcaagttagctccattcagaaagctgcctgaattttattcctcctattctgtcacagagctttagggttattctcaaaagttctgactataccaagaagatagcacgttctcctcatgaagttcaagagaccattaactaaagaatgggcctcaactctatctctaatggcctactaaaatagtaaagagtagtattgctacagtggtaccattttattttattttattttattttacttacttattttatttatttatttatttatttatttatttatttatttatttatttattttgagacagagtctcgctttgtcacccaggctggagtgcagtggcacgatctcagctcactgtaatctctgccttccatgttcaagagactcttgtgcttttaaatactacctctgtccattggctttttttgaaggaatcatgcaaaatttgcttgtttggtttgttgagtcgaagtaatacccttaacctccactatgtgtgttgaacaagaggtcagaaggaaatagtctctgaggtagctcttgcaagaagatcttaataagtttgggttgataggcatccaagagtttactgattttaaggatgccatccctctaaaattaatgtatgcccaataggttatcccatgtagtttccttccttttccattgaatttctaagtgttgattgtcaccatcttcatgacatgagacacaatggggcctcaagactcagctactcaagaggctgaggcgggagaattgattgaacccaggaggcagcggttgcagtgaactgagattgcaccactgcactccagcctgagtgacagagtgagacttcatctcaaagaagaaaaaaaaaaagaaaatcataaggaaaatatatttactattcattgaatggaggtggatcatcagagaggtcttcatcctctttattttcatgttgagtgggctgaggaagagcaaaagcaagaggaggatgggaggggttggtcttactgtttcaggggtggcagaggcagaagaaaatccacatacaagtggacccatgcagttcaaacttgggttgttcaagggccaactgtattattttagctagccgcaatgttctcagattttaaaaaatcagcattctttttacaaacggaaaaatgcagaattaatatttagaggcaattaggcatccttgtcacagtttggctctcaaacccatttcctggattttgttccctgtgctcctcatattcattctttcctattccctcttgcacacatgtattttttttaaagaccctgctgctcaaaatccggggccatgcagagcagaaaggatgagtatggactgaaactgagtcaaactagagagttttttgctatgatgattttgtcttattttcaatatcatttgtatcattaacaaaacttcttgtgtacttagaatatatagggaaaaatatcagagatgttaagaaatacaatacagatttctatctctaatctctggctttctcatttagaggagctgaagctcccatggaaagataatgtcaagaactgtgaaaggtctgagatttttaccctagagtgtcatggatgctggcagaagacacaggactcctgggtcacacataaatgcctttattatagccatagcaatagtcacagtaccagctttttcttgtgacttccccaggccccaattcccaccaggtgacacagatgacatttgacaccagcacatgacgtaagttgcattataggagagaaacctggcacttaaggaacccatgtcttaatgggcagcaggcatacctgcccttttctccagagacagacttcgttttcatattttaaggctatcccctgtataaacatccttgtaatcatagttcagaataaacgcagtcagtatccctgctggcaagagatgcagagacatggaaacctccggacaactgtctccagcagatataaggcagtagaatcatgcatcacttaataacagagatgttgtgacaaatgcatcattaggtgattgtgtcattgtgcgaacatcatagaatgtacttacacaaacctagacggtagagcctactacacacctaggctatatggtatagcctattgctcctaggctacaaacctgtacaacatgtcactgtgctgaatactccaggcaactgcaacacaatggtaaatatttgtctatctgaacatatctatacatagaaaaggtacattaaaaaatatggtgtgataatcttatgagaccactgtcatatatgcggtctgtcgttgactaaaacatcattatacggtgcataactatgtatgccacgtgctacacaagtaccagaaacactaaatatgacaaacattcaccttctgagtaagaagtgagcagctgggtgtggtggctcatgcctgtaaacccagcactttgggaagctgaggcgggtggatcactggatgtcaggagttcgagaccagcctggccaacatgatgaaaccccatctgtactaaaaatacaaaaaattagccaggcatggtggcatgtgcttgtagtcccagctactcgggaggctgaggcaggagaatcgcttgaacccgggaggtggaggttgcactgagccgagatcgtgccactgcactctggcctgcgtgacagaacgagactccgtctaaaaaaaaaaaaaaaaagaactgaccactggaggctgtgcgatctaggaaggcagctgggccagggaagggagaaactgggccagggaaggtggagatcgcttttacttattcaagtaggtgtgaagacaggcaatgcagttgaaaacctacaaaagacaagtttggtggaagggaaagttcacgtaggaaagctgagggaggttaggattggtttctggaaggcctggagaaactttcccactgtaatgaggaggaatagtaacagtgctaaccagcaacacagaggaggatgggccagagtcggggaggttaggggcaaggcaaggagacgaagggaaggtattgcaggggtctgagcatgaagtgtggaatacctgaattttttccacatgggatatatacctgtatttactcaattttattttcttcactaaagagtaccaaggcaaacttggtagataattttgtatgtttgaggattgatttatagtatcattaataagtctattaccttatgtggcacttcataacctttctcatccaagagggtgtcatccacatgtgtttagagctggtttctgccatacattttgggatcaggcacttccctgaaggtgttaggggtcaggtctagagaagctcatgggcatacccttctggcaggataagggagagatttggtgtggggcagactgatagacgtgacacctattgcacatagaagaccagttacagtaccaggttcaatgtgagaaagttagtttaaaggacacatcctcaagaagacgtagggtactaacaaccaaatggcttaaacagaggagcccttgataaagtaagtgctaaatagctatttccttaaccttaactggagattggaattctgtgttctatagtggtttcttatgattcttatgtaataatcttggctccttggttgtaagaaatgcgggcaagtctcacacctgcctctccaaaaatgaatgaagtgacaccttaaatgttccccaggcttgcatcaccctctgggggcctcccacaatcctgggtcctcagcgattctacggtgaggccactagatcacaatcgaaggctttggcagaccaccatgtaagcaaacccctaaatatttttaacagacccaagactggcaggagtcaaactttatatattaagggggtattaaaacacagctatttccaataattcattatgcacatactcataaacacattacacttgtcacagaacatatacctgtagtgtgctttccagcggggactaaacaacacttaatgagaacgctggtggtgttttttgatgtcaagaaccccaaggttccagcagtgaaggggcatcgcagttggtagtctttttaatgggaagtcccctggcctttggctgcctatggtgtgtcagccacaagttgggaaccacagcacttggtgaaggagcaatttcccccatggccttactcagacccatcattagacacttccctgaaagtgagcctggaagtttgcatagcagccagtgtaagccttcagggagaagtggagtgaatatcgcaggctcatgtcaagaaaaggaatcatctgtcacatgtgaaaaaagcagtcaaagtgccagtgtactaatggaaaatgaccgcgcccaaagcattgtctttcattgtggataccaagcttaaaaaggaatatatatttttcaagtgtacagaggagagatgcattcagaataggttagtaaggtgacccaagccacgtcaccttgggagcagtcgaaggaataggatgcatgtggaaagacctgggaggccatgctagttgccctcaaatattttgagggttgtcaagaggaagatttccccaggagcatggtaggcagaaatcaacaataaaggatggaaaccacgaaaaacagatttataacagagagggggtcaaggggaacccggtctaatagcacttttcaagaatggaacaggtggcttaggagatattgacttctctgtcatttgagacattcaagccttgacatcacaaccacattgaaagaatattgcaataggactcgagcagctgatcatggaattaagtgactttaattttcaaccctaggactctgtgattctatgtacacagaattcgaatcttaagtagagtgtccttgtgaaacccctacaactttgattgaaaatatatactgaattaaaatctgtatggtaataagtttctttttagtgaacaggaaacatgccaaagtatatcttaacattcagttgtagataattatgtgagctgattttgtgtcaatgaatctgaagttctgatttggtattagaaaatcatacgacaccccaagctttctcctaggaagttgtcttttccatttttagcatttcatttggttgtctgtcatcacctataacacacacgtgcatacacatacaaatgctgctataattaacattttgggttcctttatcattttttaaacctcaaactttttgttatgtaatgcacacttatttgaaaacatctcctgttgaaaatcacagaggtcacaggtagaaatgctgtatatccagcactggtaaggcaaatctatgtatattgaactactgagaatatgtacaaaaattaggtagaaattagagaaaacagctctaaggattgacaaaaaaaaagtagaaagagtaggaaaagttgctctgctccaaagagataggattgaaaggtttttgcttggtgtcctagaagataacttcccttctttctgcttcatcagggtagaggagatgagaggagcaggtatcagggtccctgactcttagggattctcagcctagagactggtttactgtacttgcttgctttatggtcaacagttgactttgcatctcagaggagctgtgaaagggctcagagagattctttactctttctctacatcagaggccagaaagagataaaagagaattaggagcaaatgtatttgtttccttgccacccaaactagcatcaaaatatgctgaaggccagggtggcctgagctccttcatgacccatggcgcttaacaaaacatctgcagaggaaagtgtaccagggcagaggggacttttccacaaagcacggtcatgccctgcacaaccactgaggaatgaagtatttaggaatcttgtgggaaaactcaacaaattctgaagacagaaaggcacacaataaatggtgttctgttagggtgttgctaatgttgatgacactcagaagtaaggaaaaagaggatattctcacatttcagaagattctggaatagagccaattcctggtgtttctttgttgttctaaaaagaaaagctttttttgtctctgttttccatataacatcaaagaattgagtaaccatctttatcaattaaaaacataattgatccctgcagcctggctgttgtgcagacaatctcccactctctttcccgagaggtgtctgtccccgcagatgtgggctagcaaggctggcacttggtgactgtgagattgccttgaaactggtgactagaaattcttttgttacgctacttttaacttaggttttatctatgggaccttgacatttttaatactttaggcatttctgcatgcttaaagaaggtagccctaatcttattgctagctaaggagtgtgtgacacttatacctatactacctggagagcttgattcataggtgctgctcatcctgtagtggtgtcctgctgtcccttttccccagtccctgcaccccaccccagcatcctctccattagctccctgaaggagtcatactgttttcttgttccctgagagctttctattgataaaagttctgtctgtcttcaactacaggaagaactgtgggtctctctggattctacaggcacctggcaggcatgagagcactctcagagacagggctttggtgggctatgaatggaatgccctctgagttcccctgaaaggaggatgggaaactctagatccctaactgccctcagggtacccaggactggctgaaatgatccaaactcagaagttgagtgctcacgcatagggccataggggcctgaggtaaaacagggtgagtctagccatcctgataaggtctgaggggaatttaagagcataaaaattagcccagtcagtgaaagaaaaaatcagattaatagtgactaattgtttggtcctgcacttgctctacagaaatataatgcaagttacatatgtaattttgaatgttctagtaaccacatcaaaaataattaaaaaaaaacagatgaagttaattttaatattatattttatttaacccaacatgtctaaaatattattactttcttccaaacaagcaaaagctgaaggaatgtgtcaccactagactggccttacaggaaatgctcaaaggagttctacatctggaagtgaaaagacaataatcaccatcatgaaaacacacaaaagtattaaactcgctggtaaagcatatacacaaaggcgaaagagaaaagaatgaaaacttatcactactgaaaaccatcacatcacgatgataaatagtaagagaggaagaaagcaacaaaggatacataaaataaccagaaaacaattaaaaaattaagaggagtaactcattacctatcaataataccttgaacataaacagcttaaattccccacttaaaagatacagactggctgaaaggattaagagaaaaaaaaacatgacccacctatgtactgcccacaagaaactcacttcacttataaagacatacatagaccaaaagtgaacggatggaaaagattctgcacagacagaaacaaaaaataagcaggagtaactgtacttaacatcacatgaaatagactttaagtcaaaaactgttaaaagagacaaaagttactatgtaatgataaaaggttcaaaaggatccttcagcaaaaggatatacaactgtaaataaatatgcacccaacacaggaacacccagatacataaagcaattattgttagatctaaagggagatatagactccaatacaataatagttaggaacttcagcacctcactctcagaatcgcactgatcatctagaaagaaaatcaacaaggcaacattgtatttcagttgtatttcaaatggacccaacaggcatttacagaacacttcatccaacagctgcagaatgcacattcttttcatcagcacatgaaacattctccaggatagaccatatcttaggccacaaaacaagtcttaatgtatttaaaataattaaaatcatatcaagtatcttttctgagcacaatggaataaaactaaaaatcactaacaagaggaactcttgaaactcttgaatacatgaaaacttaacaacatgctcctgagtaaacaatgggtcaacaaagaaattaagaagaaaatttaaaagtttcttgaaacagaagaaaataaaaacgcaacatatccgaatttatgagttacagctacagccaatctaagaaggaagtttatagaaataaacacctactttataaaagtaaggagatttcaaataaacaacctaatgtaggagctaagaaaagtttatctcagggaggtagaaagtaggatgatgattaccagaggctgggaagggggttaggaggttgtaaagaggttggttaatgggtacgaaagtacagttaggtggaagaaataagttctggtgtttgacagcacaacagggtaactatagtttacaataatttattgtaatagccagaagatttgaaacgtttccaacacaaaaaaaaaatacatgtgtgaggagactgatatgctaattactctgatttgatcattacacattatattcatgtatcaaaatatcacatatggaggtggggcaagatggcggaatagaaggctccacctgtcgtcccgtccccgctgccccgccaccgccctgcaaggacaccaagttaagaactatctatatagaaaaaaataccttcgtaagaaccaaaactcaggtgagcactcataagtacctggttttaacttcatatcactgaaagaggcactgaagagatacaaaaaacagtcctgaatcgccactgaattgccaagacgccacccctgccccaccccaggcagcagtgagtcctagtgtcgaactaagctcagagatggtggactcatggggcatgcgacatactgagacaccagctggggcagccaaagaagtgctggcatcacccctcctctagtcccagactgcacagctcacagcttcaaaagagaccttctcctttcacttgaggagaggagagggaagaatgaggaagactttgtcttacatcttggataccagctaagccacagtaggatatggcactggtcagactcatgaggcctccattccaggcccttgccccaagacagtgtttctagacacaccctggtccagaagggaaccccgtgccctgaaggaaaggacccagtcctggcaacatttatcacctgctaactgaagagcccttgggccctaaataaccagcagtgatagccaggtactacatcgagggccttggtgagcctctgagacgtgctggcttcaggtatcaacactgccacagtgggtaaagtaccaagtgggctcctagggtccacgattccaggacttgattcttggatggcatttctgaacctgccctgggccagaggggagcctgctgccctgaagtgtgattaccaggctaggcagcattcaccacaagctgacttaagagaccttgggccttaggagatcaactgtggtagtctggcagtactcctcatggccgggggtgatggtgcctaccaggggcaggggtgtcctctgcttttagaaaggggagagaagagtgggaaggactgtgtcttatggtttgagtgccagctcagccacaatacaataaaataccaggtagacttctaaggtttttcagtctagttcctgactcctggatggcacttctgggcccacccggggcctggaaaatcttgctgccctgaagggaagaacacaggcctggctggctttgccacctgcagattgcagagccccagggccttgagcaaacatagacagtagtcatggagtggttatagcaggccttgggtgagacccagcactgtggcctcattatgagtttagtcataatggttgtggtcacaggggtactcgtgttactccaccccccagctttaggtggctcagaacagagagactctgtatgtttgggagtaagtaaggggaaagaacaagagtctctgcctggtaatccagataattctcctggatcttgtccaagactatcaaggcagtatctctacgagactgcaagaaccacagcattactgcgcttggggtgccccttaaagcaaaagcagtttagatcacaacacccaagtcctttcaaatatctggaaagccttgctacgaaagacagctataaataagctcagatagtaaagactacaataaatacctaacccttcaatgcccagacaccaaagaacatcttctagcatcaacaccatccaagaaaatgtgacctcaccaaatgatctaaataaggtaccagggaccgatcctggagaaacagagatacgtgacctttcagacagagaattcaaattagctgtgttgagaaaacacaaagaaattcaagataacaccaaaggaattcagaattctatcagctaaattgaagaaagacattgaaataattaaaaaaaaagaatcaagcagaaattctggagccaaaaaatgcaattggcataccgaggaatgtatcaaacccctttaatagcagaagaaagaattagtgggcttgaagacaacatatttgaaaatacacagtcagaggagaaaaaagatcctgcaggatctatatagaaaatagcctcaaaatagctttaaaatagccttaaaagggcaaatctgtaattggccttaaagaggaggtagagaaagagatgaggtagaaagtttattcaaacggataatagaaaacttcccgaacctatagaaatatatcaatatccaagtacaacaaggttatagaacaccaagtagatttaacccaaagaagactacctcaaggcatttaatagtcaaactcccaaaggtcaaggataaagaaaggatcctaaaagcagcaaaagaaaagaaacaaataacaaacaatggagctccgatacttctggcagcagacttttcagtggagaccttacaagccaggagagagcagcatggcatatttaaagtgctgaagaaaaaaaccctcttgccctaaaatagtatatccagtgaaaatatccttcaaacgtgaaggagaaataaagactttcccagacaatagaagttgaggaatttcattaataccagacccatcccacaagaaatgctaaagggagtacctcaatcagaaagaaaaggatattaatgagccataaataatcacctgaaggtacaacactgactggtaatagtaaacagaaaaacacagaatattataacactgtaactgtggtgtgtaagctactcttatcttaagtagaaagactaaaagatgaaccaatcaaaaataataactacaacaacttttcaagacatagtacaataagatataaatagaaacaacaaaaagttaaaaagtgagagatgaaattaaggcaagtttttattagttttctttttgcttgtttgtttatgcaaagtgttaagttgttatcagggtaaaataatgggttataatatagtattttcaggcctcatggtaacctcaaaccaaaaaacatacaacggacacacaaaaattaaaaagcaagaaactaaatcatatcaccacagaaaatcatctccactagaggaaggcaggaatgaaagaaagaaagaaggccacaaaacaaccagaaaacaactaacaaaatggcaggagtaagtccctacttatcaataatgacattgaatgtaaatggactaatttgccctttgccttgacaggctctacactgccctgtggaagagctgccttgggtgtaggaataaggttgaagacccttcctggattctgagaattaccacaaacttgcattcctggaatacaggtttttgtttttattatttatttatttattttttcgagaagaaatctcactctgttgcccaggctggagtgcagtgccgtgatctcggctcactgcaacctctgcccccccgggtttaagtgattctcctgcctcagtctcctgagtagctgggaccacaggcacacgccaccatgcccagttaaattttgtattttcagtagaggcccacctcactatgttggccaggccggtctcgaactcctgacctcgagtgatctgcccaccttggtttttaatagttctgtctggtatctgtaatcagaatgggttctctccaaagaaaggctgtaccattgagggaaggaacctgaactgagaagcagtagacaggaattcttattctttatctggtggtcattagctccaaataaactctttaacctatcttggtcattttcctctgtgacccctaagttctgatattttgtgattttgtgtttataccagtgaaacctttgtggttatagactgtatgaaataccagtgacaatgaacactgagaatcctggaaggttggggagaaggagctgagtgggtggggctcatatactaatgggtaacatggggctggcgttctatccagtggatcaatcaaaaagcaaaggaactgagctggtggcataacaggcagctgagccaagattcaacggacaatggggggagaatgccaattcaagcagcagtcaagcaatatttatgactagattttcaaactgttaaaagagtctgtggtcaagtaagttgaccagtgtttacaatcttctatttcagtggaagggtggggattgttggagaatggggcttctaaaagatattattagcatctcactacttgacagcatctgaacacatgagtaaagtagaatattgaaattacctaaataatgaaataaaaatcacttttatttcaaccagctcaatattttatgaaaaatttctagagatatcccagttcactttttaacattacctctaaacccaaaaaataaaatgaactttaataaacacagagtcacaggtcatggctgtccataaaacaggactagaacgtgtttattcagggttttcaggaagtttagttgatggattcagttggaagcaccactaattgtaccttctcaattaacaaaataaccaccaaattaaccaaacattgtggttgtaaagaaacactatcagaatagtacccttatattgtcttaagtatcattttcaaaatgttaaaagtatataggtgggtgtgcacctcttaggatggttcttataaaacaacaacaactaccaaaaaataacaagtgttgctgaggatatggagaaattggaaatctcatgctttgctggtgggcctgtaaagtggcacagctgctgtgaaagacagtttggcagtttctcaaaaagttaaacttgaaaccgctaaataactcagcagttctattcctgggtatatacacaaaagaatttaaaggagagacttgaacagagatttgtacatccatgttcatcgcagcatcattcaccatagccaaaaggtagaaacaacccaaatgtccatcatggatgaatggataaacaaaacatggtatgtacatgcaatgggacattgtttagccttacataggaaggaaattctgacacatactacaatatggaaaaatcctgaagacattatgttaagtgaaataatccagtaataaaatgaaaacattgtacaattccacttatatcaagtacctagtatagtcaaattcacagtgacagaaagtagaatggtggttaccagctgctgatagaagagaggaatgggaagttattctgaaatgggtacaaactttctgtttggtaaggtgaaaacactggaaatagatagtggtgatggttgtacaacaatatgagtggacttaatgccactgaatgacacacttaaaaatagtgaaaatggtaaatgttatgaatattaaaccacaatttatttgtgtatgtgcgtgtgcatgcatagacaacacacacaaaatcctgaccttcccttttttccagatgttttcagcagatttattcataatggccaaaaaaatggaaactgaatgtccattaacagggcaactgataaataaattgtagtatacaatgaatattaatatggtaggcagaattttaagatgaccttcaaggttcccaaccattgatatacatgccctgaatagtcccctcaccttgagtgtgggcaggatgtgaggaagtaatgggatgtccctcctgtgatatcattcctataattaagttgtgttatttggcctaggtgaggggattttttttattgaggtaattatatacctacatatatatattttttgtatatatacatattatatacatacatatatagattttatatatagataaaatttaccatctttaccatttctaagtgtacagttcaatggtaataaataaatttatattcttttttctccttcctccctccgcttcccccttcttggcctctggtaactaccaatctattctctgtcttcatgagatccacttttttcacttccacatatgaatgaggacatgcaatatttgtctttctgtgcttcgaccttacctttgtgcacatcgggcaagtggttcgtcttcccaggtatgaagggagtgtcatttccttttctccaaaacttcctttcaaacagagaggataattaccagcaataaaggatacttggcacaaatttggaaccaaatccccttccccttggtttaaagaccatttgtgtacaaaatggccagtctgaagttggggatacaggttaaaaagaagaagaagaaaaatcctgtgcaacttcagagagcttacactcgtggccaaatggaacaagtttcttttttatttggtacataaatttgtcctaagcaatgcactcaaagggaaaattcccaaacagcagtgctgggtctacagtcatttgtcaaattaatcatgatatattttcttgccttgaatagtgtcggctggaatatgttacattccattctaggaagggaatccaagtgaagaattcctaaccaacaatttttcagtctacagaaagagtgagagtccaagtcctttcattactgttcacaacactttttccatggtctttcagttgggaagatacagtcaaatggcagaattaggattgaaacctcatacagagttatgaaaccaacacagtgttagtgttaagggagaccaggattccaattagaggcaatgctgggtttggtacaagataaccacttagggaaaatggaaaaataatgtcaggcctgataaatatctgacaaaaacttaaagaaagagtccaaatgcttaactcagtcttttttctgatactgcatctgaagtatgtggatcatctgataatgacatttcagcattcagccatataatagttgacaaagtaatgtacttcacactgaaagctgtaaaactatagtgaattataaaattagatatcaatttgaatactacacaatttttaaaatgtaaaattttgtaatacggaaatgttatgttcatttacttcatttgaagtatgtcaatattctatttgactcagcaaacataatctagtcaccttgctcatgagtgtccacaggaaaaaaataaatttggctatcaactaatttctctagtttctgaatgttattagttatgagttttttctcctcctcttccaaatttggacctaatattaggacaagggacatatatatctctacataaaaagcagagggctggaaattttctgatcatctggattttaaaaaacattccccatggaatgtacaaccaattgaagcaatatttttaaagaaaatacatttttcttaatgtatcatgttaattccctctattcttgtcttgtttgaatgtgagtaagcagtccattggaaaaaaaaagatattttcctgttgtagtaaagaatcatatcatctagctttttgggattggtgtagaatccagacatcctttatactatgtaatatgatgactagaatttaacctaagtgattagccaatgcactagattaaaagtgaatgaatccactcaagagacaggcaagcacacaggcaaagcagtcatccttagcatctaactcttaccttttaggttcatgtgagcatggggagagtagacaagactgaacatgaggacaaaaattgctagtcacctgaggccagatttttgtcttggattgttttgggagaactttgccaacaacttagaaaaaaatgattaacttggacattcacctataattcttagaacccctcccgctggtgcaaaatattagcataggacactcttgttaaaatggtcctttgaggtttagtatctctaggctaactgaatctgcctcaatctcatttcatctgaattataaaagccacatgtgttctgatgtcccaattatgttgtcacatagagtcatgcaagctagcaagctttgggattagtagaggagaacattttgaaataatctaaaaaaacaaacaaaccatgctttttaattacaagaggatggggaatgagattttccccaagtggaaattgcacccaaatggaaggaaggctttacaaaaacagaattattgaaaaatatcagtaaaataatgtctaggtgttaagtcaaatagtgactccgtatatattttagcccaattaagcccataaaagttgccaatttatccattcattgatgaaaacctttgctgaatgttcactatatacgaagcatatacagtcatgtgccacataacaatgtttccatcaacgatggaccacatatacaacggtggtcccataagattatactgctgtatttttactgtatcttttctatgtttagatatgtttagatacacaaatagttaccactgtgtaacaattgctacagtactcagtgcagtaacatgctgtccaggtttgtagcctaggagctacaggctatactatatagcctaggtatattgtagcctaggctacactatatggccttggtggtacagtgaactataccaccctaggtttgtgtaagtacactctgtgatcacacaataacaaaatagcctaatgacagatttcttggaacatattccagttgttaagtgacacatggctctagataagtattgaataacacccatgtgtaagggaaatgaagaaagagcaccctctggccctttgaggagtgtcattctcagagatgacccacatcagacatggatggctgcctgtaccaggctaggctctctaccctattttctcacaaggaggagagtgatttagaatgtcctggaagtatttcattgttctatcatgtttgcaattgatcagcattagaaagaaattttgcaccatggagagtcaagcatactaatgacacaatgtgtacttataagtaaactcatccctactttgaaacccatcaatgaaagcaaacttttggcccctgggagacacagtgacattacagtttgaaaacctattccaacaaagaccatcaaatcaaggactgagtcttatccacctttgtacttgcggcaccgtgctttgctcagagtaagtgctcagaaagtcttgttttatctagagtgaaagaggtaggcttctgcacagcgacatacatagtatgctcaaaagtagcctgagtagaggctctgaagtgtccccagtgcagtgatccaagtaacttaaggttaattttgccaccctgtgtaaacacagactgcctgaggcctcttcatttcatttagtttgaaagtcacacaagacagggttcagaatttaaaaattggatactctcttggatattggtgatgggccatgaaaaataaattagttcctttaaggagtatttttaaaactcaggaattgcttagagaaaaaagaggggcaaagcaatttttcccaataaatttttctgtaatcaattaaatctttttaggatttggataatataacagactcagaattttgtcataaaaaataaaattgccaagataataatataaaataaatgtagaatatttaatttttatgaattttctttttaataaaaaattgacaaattatccctcaacaatcttccaactgtttaatgtattaaaatgatatatgctatttaaaaattattaggcattcattaaattggcaagattttagatttcatgtattcaagattttgctttggtaagaagcaaattctataaactccctattggaaacacgtattttgggaattagatatttttcaatgtgagctgctgttttcttctaactgcagggaaaatgctgtctaaaagaaaataataaatttgtatctgctgagttctcttagcataaggcaccaacaaaacaagcttcaggaagggagaagaaaccatcctcccactcatccttcagaggatttagataaagtgaagggaagaatcgttctccagctccttcggaatttacgccggcatcagggcaggcttgttactgctggatccattgtctgctcaaggttacttattccactaagacgtacatcctaccacggaccacggctttgtagctagccaggctctgagtgtgtgtgtagatgaaccatttctctctccagtaaatgaatgacagtctttctagggctcttgtcttctgctgggaggcagagcatctctagcccaggaagaatgcccagacagagtcagggggaatggggacacgagatagagttcatatttgtgatctgtccccttcgtttctcttttttctctctctccctctttcttttttttttttttttttttttgcatgggtggtggtcgggatgtgttgtttttgttgttgttgttgtttaagatatcattggtaagcatctcaatatgtgtttaccagatagtataaactattataagaacagaagataacaagacttttaattggtacagaaacctatattgggcatctattttgtgcaacccaccatgcaggtcatatgagagatgcaagacaatgagacataatccctcctttgtggagcttacagtctaagtgactgagaccggctcacaggtaactgagtgtttcagtcatactgacgtgtcaggcagtctttggttgctgagtacatggttataaagactgtgaagaaacaaattaccattccaccaaagcaaatcaaataacgaagacccaaattggatcacttctcattttctatttttaaatgtacttcataaagacatttacttactaaaatcagtttttgtcttatacaacattaaagtaaccatatgacccttttaatatagttcaaggaaattatctgaattaagtaacttgatttgttatttttcaccattgtgggaatttttagaagcaccatcattctaactaatagccataaaatacaagtttatttaatagtttcttcaagttacatatgttcgtagtttagtgacaaaaggtaaataaaattaataaacttcataaaaatcagtggactctggaaaacattttaaaaattcctctgtgagcaacagactttcaacacattttcccccaaagatcaaagggcatgaattaaaatgaaataaggaaagtctgctaatttttaacctttaaagattaagtatttaggaagagatagaaactgaaaatgccatatgctttttgaaaattaaaagaaacatggaaaccctgttcacatgataaaattatgactgtgcacaaagaatttttagaagtcattactcctggatactaagattagaaatacttatatactaagtagagtcatagtcagaaaaaagaaaccatctgattgatttatgagaatcaattcaaatagtcctttgaagtattagaatcattctgtataatggcaagcacatggtagggtagtttcctaataaatactgggtacagttgggagaaaacaatgcagttttggactagagaaccaaaaccttctggaattttctaggctttttgattatggccaagccgccactgggcctgaccgctggcattattggtatcctaactttggctttttattaaataaaaataagaaatatttctacaaaggatcaccccatcctggaggcagctcatagtacagaaattggaataatcttgtcttaagtttctaccaacctcgtccatcctgctacacacaccattttatactccaatgagtatttaattcaacaaaaaataaaaattaaaaaatggccatttcagagtgaaaaaaaaaatgttcaggcaaaccagtttttggattgacttgcctggtaagtattggcaaatggtcactctggtagcctatgtgcatacccatcccaggagaggctattaagtcctgaagggtggaagatggaaaatgagttttgttttgcttttttgctcttgttgcccaggctggagtgcaatggcgcgatctcagctcaccgcaacctccgcctcctgggttcaagcgattctcctgcctcaacctcccgagtagctgggattataggcatgccccaccacgcccagctaattttgtatttttagtagagatagagtttctccatgttggtcaggctggtctcgagctcctgacctcaggtgatctgcccaccttggtctcccaaagtgctgggattacaggcgtgagccaccgtgcccggctggaaaatgagttttgaaagcaagaaccatactgacttcttaacacttgggtgccttctttttcttaccatttcttccttaattgaggcacaaatcttttagctgttatgcagtgaatatatcatggaagaatttttcttttaaaaaggaaaacaaagaaaaataaaattcaatgtctaaaatatggccatggagtaaactaataatatgcaaggtgtgtttacatgtagtctacctttatcatttatgattttctttaccagttttatctccagtatataactttacaagcattatttttacgtgaagctgtgatacttcgtggatgaacttgacaaaattagattttcttttgccaagtgtattagggttctccagagagacagaactaataaagtataggaagggatttatcataagaaatttgctcatgtgattgtggagtctgagaagtccccagatctgcagtcagaaagctggagacctgggagagctgatggtgtagttgtagtctgagtccaaaggcctgggaaccagaagagccaatgatacagttccagtctaaaagctggctgacccaaggctcaagaagagctgatgttttagtgtgagtctaaaggcaggaaaatccgatgtcccagctcaaaggcagacaggcaggaggaattacctcttacttgagggaggtttgggtcttttattctagccaattgattggatgaagtgcacccacattaggcagggaaatcttttttgctgagaatgttaatctcacccaaaaacacactcacagacacacccagggtaatgtttgaccaaatgactgggcaccctgtggggcagtcaagttgacacagaattacccaacacagcaggtgagattcaatcacatgattcagtaattttaataattatatgattaaatgctaataaatttacatgcaaagaattttgcctatattataagctcaagtatttggccatagaacatttaaagacatgcttagccaatttaaggaaaaattagttagccattgcaacattatcttcaaagctattgttggaataaaaactatcctaaaaaagtagcccccacttaatgtgttgattaattcatctatctagccatgaatgtgttccacaaactttagttgagtatctactatatgctaggcactgtgccaggcatatggcacacagataccaaagaaaataaacctggtttctgccagctaggaactctgtctggcaaggtgggacagccaaataaataaattaggaggaaagtgttaatggtaggctggcctgaccacacatcgtattagcctagagcagtcctcttttctatctcttttctcaatctacgaatagctctctatcatttgcaaacataccctaagttgggcaataaattttgcagccacctgggtgtaggcgatgtgagagaagtttctctaagatacagtaggagtgcccatggagggaacagatgatctagctgttggagggtgggagaaggagagccctcaatcctgggattaatcctgaaaaatgagagtggtgtttaagatgcagagagaaaaggaaaggagctttgtgaaagaagggaactctgtgcataaggaaaaagaggcagggctcagtcgtaggtgcaggacaattgtaaatatgcagatctggctagggcagtggggtctgaggggcttgggaggcaataaggccgtggggggttgcagccaccacatcccagaggcctcactctgttgtgctaaagagcttgaatacatcccgatggcggttatatgacacagtggcagtcatggcagataatggtttggttagatttgtgatttagaacaacaaacacatctggtaaaagttgacttcctgggccggacatggtggctcacgcctgtaatcccagcattttgggaggctgaggttggtggatgacctgaggtcaggagtttgagaccaggctggccaacatggtgaaaccccatctctactaaaaatacaaaacttagccaggtgtggtggtgcttgtctgtaatcccggctactcaggaggctgaggcaagggaatccaggaggcagaggttgcagtgagccaagatcatgccactgcactccagcctgggtgacatagcgagtttccatctcaagaaaaaaaaaagtttaaaattcaattattacatattttatcttagactattgactaacttcacattcgtgcaatacagaaatgggggaggtagcataatagccaatttttccaattgatgggaatacatcctttgcttttgtatatttttgtgagaaaattatttcaatttaagcattatgtaattagtgaccacttttcaggaattgaaccactctgtaaatccagatttgtggatggggagacagaacatcagaaagttatgaaaataaaacttgaaaaggtaatataaaatttaaatgaagtgggaaaaagagtcagaaattctttacactttcagaaatttgattccttcaaattatatgtgagtttttgtgattatttactgatcactgcctacaattacactgtttttaagggatgacacttggcaaccatttaactgaacttcactttcccattggaggtgtcggatgtcatgagaagttaagagactaggcaagtcatagtcagagacatccctagaccagtgtaacatttcccaggaaagacacaagagttgtatttatcattacattcatttccttaatatagctcatatccttttttgaaggatatgttgtaagcctgaggtccttttagaaaatctcaatttgtctgacaagaaaataaagatcacaaaaacccttagtttctcaacaagaaagtaaataagatgaaaaatccttgtgtggtgagttaatattttgaaatctctctctctcttttcctctgtattctctctcaccccctcatgtctcctccattcaattaaactagtaaataagatgaaaaatccatgtgtggtgagttaatattttgaaatctctctctcttttcctctgtattctctctctccccttcatgtctcatccattcaattaaactatatcatcttctgcttattgaaccaagaaaggaatgtgacagaaagagaaaaaaaagagcctctactaggattttgagtttacagagacaaggccttggggaagcagcaaggattcatggcatagaccaggggttctaaccaggcagcttgtttccaccccttaggggacatttggaattgtgttgtgtgggattggggagatgtttgtcacaataactgggaaatatcccattatctacaagtagtagatggggccaaggatgctaaacattctgcaaggagtggacagtcctacataccaaagaagggctgaccccaagtgtcaagagcacccctgttaaaacttactggaaggcaaagatatagaaaaattggaacccttgtacattgctggtgggaatgtaaatggtgcagcactgtgaaaaagagtttagcaattaaacagagaattaccatatgatccagcaattccccttttgggtataatccttttgcatccaaaaggattaaaagcagagatttaagcagatatctatacaccaatgttcatggcagcatcattcacaatagtcaaaaaaggtggaaacaagccaagtatcaatcattggatgaaaggataaagaaaacatggtgtatacatacaacagaatattattcagacttaaataggaaggaaatctgacatgtgcttcaacaagataaattttgaagatagtatgttagtgaaataagccagtaataaaaagacaaatatgtaactccacttataggaatagaaagtatctagaatagtcaaattcatagagacagaaagtagaagagtggttgccagggcctgaggcagttagtgatgaatggatatagagtttcagtttggaaagatgaaaaaattctggaagcagaaggtggtgatggttgcataacaatgtgaatgtacttaatgccatgaactatatacattttaaaatggttaaaatggtaaattttatattatatatattttatcacagtttaaaaataaaaaatgccactcactcaaggagaggagctgacgttgaaagcaattctgttttgcccttggtaccaaaattgaagaaggctgggggaagaagcatggtgggcaagcatgagaggcagatagtgtgggctcctgggcaagggcctgcaccctgctcttggggaatgggcagaaaccttgacagatttaagacaaaggaaacttggacctcatttcctaggtaaatctctgagggggaaaaaaaaaatatatatatatatataatgaattgaagggtaggcagatggaaataaaggcctcataaggattgaatttgtgaccacagacaacccaggttgattcgcaagtcagtgtgcactgagtagagacaacctacagaaccacacgagcccacccaatgccttggttctgtgtgagccaccccagaattcacaggtaacagcatatggacagggaaagttcctgaactggctgcataagggcttgaaatagaattttaattgcatcataaagttaaatttcttgcatactgaatctccagcctgatataagaagccatcacagctgggcatggtggcctgtagtcctagttactcaggaggctgagataggaggatcacttgagccaatgaggttgaggctgcagtgagctatgattgcaccacagcactccagcctgggtgacagggcaagatcccatctctaaaaaagaaaaaaataataaaaaattaaaaagaagccagtattacattcctttcagctctaagctaccctaatgcttggagccttcatagtaacattccatggtaattttttcacatgtatgagattttccatcataagtgactacaattagcatatctgggtgatgtgtatgtgttggttccttgttttacctggaacagaaggaaggaattggctgccagatatttgaaaatttgttgttggaaatggcagcactgcatgtaagaggagctttttcaaatgaatcagtagataaaaggtggaagcttggctcttccagccaagctcccttcaacaagaggaatgaaaattgtagttcaatgcctgctgctcacttatctcgtgtctcatatcttactgcaacttccagaatgaaaagaccctgccacaatgaggggctgagtaattaattgcctgaaacacatgggtagtctgaaatttgagattcttataaaggtgtgactcacagctttcttagaaaaagagaacaaatatccattgcaccaggaacagggaaatttccctcccatcttcttctctttcctattaggtaagtgctttttattcggtcattcccaaaatgttttggggttgggggtgcatcgatttagcacacaccctatggagagctgggatactctcctcttccaaggcagcacagcccatacccaagcagctttcaattgtaggtgactattttctatctgggagtggaggaaggaaagtggaaagttagttgaataaatataattaagctactggtgtgagatatttcagcacagggtcttgtttttgtttttctttaaaggaataatgctaaacccagttggttttcttttttttcccttccttccttccttccttccttccttccttccttccttccttccttccttccttccttccttctttccttccttccttcgagacaggatctcattctgtagcccaggatgaagagcagtggcataatcatagcccacttcagctttgacctctcagtctcaagtgatagtccccccacagcctcctgagtagctgggaccacaggcatgcaccaccatacccaggtaattttttaattttttggtagaaacaggatctcattatgctgcccaggctagccttgaactcctcgcctcaagcaatcctcccaccttggcctctcaaagagctgggatccaactggattttggagataaatccctgaggaaaaaaactgggcttggctccccagaacacctggattttagtatctgaaaattaaagttaattggaaaaacataattccgacttaatatagctttaacctgctgatctcaatgtactatgattactcccagtgttaattttaagtttgaaatatagtctcatgtaagaggtgactcacatagaatctcatctcttcatcttaataattctactgcagataaatgttctctgggctattaaggcaaatccttgtaatcctgggaatgtggtccttaggcaactaacctcttgatggaagaaaaaaacaaaaaacaaaaaacaaaaaaaaccagtcctggtcttcatcacttttctgtactttactaagcttgggtttgggtagtttccagttttctagtgtccagagagaattcatctgcctataagacttctgaatattcttattttcctcgcatttctgtgtggactgtctcagtgttagcttttcctcttgcttgctcctgctctctctcttccctcacaccccacaccccttcaccctgggaattaaaggcatgtactctgcagtctcagtaacaccagcttttaagtgagaccacagtacaaaataataaatgagattttaaacagtgtttgaagtgggtgcgagccatgttgtacatttcaagaccaatattcttgcagaagccactgtggaagatgacgaaaggaaaatgaatcacagatgaggaagaaacaaaaacaaatgaaataaagaaaacgaacggacacagactttaggaatgatgtttgattcctaattaggcttgatattaccatgtttggttactggtgtgttttcattcatgtcttttgacctgcttaaaaaaggaaagaggtcacttcaagggatccacatttcaatttcagtgtgtggcacaattactctatactaagagtctactagccgtcattcccacagtaaggcctggcttgttcgtacactgggtgcatctctgatctaattttattatggatgacagcatgacattcatttccaccacattctacaccgctccaattctgaacttggcatgtaatagccataaaataacatgagtaaagaaggggactcctgcacagaactctggaaaccaatgcccaatttacgagtccaagcatgcatgactactgtaaaccagaatggtactaaaaccaatagatatatgagaagaaaatgaatagttacgtaaaggtttattgtagacactggttcattttcataattttaggttgaatatacccagctgatgaaagctttgaaaaactgagtataattccttattaaaattaaaagcacaacctgttttttttgtttgtttgtttttttgtttttttttttttttgagacagagtcttgctctgttgcctaggctggagtgcagtggcatgatctaggatcactgcagcctctgcctcctgggttcaagcgattctcctgcctcatccttcgaaatagctgggataacaggcttgtgtcaccatgcctggctaatttttgtatttttagtagagacggggtttcaccatgttactcaggctggtctcaaactcctgacctcagtgatccactcgcctccgtcttcgaaattgctgggattacaggcgtgagccaccatgcccagccgacctgttatttttgaaagaaagctaactttagggaactcagtatttgcatggcaccaaattatcaccccaggatgactagcgaattgacaaagggaaaatatatcttaatagtaaagagaattgtggttgccattaccttaatttgggaatcaaacttggcatcactaatagtgagaaaaccaggctcaatgtgatcctgatgccatgcactatgtttttaaaatttttattaaaaattttttttgtgagagagcctctcggtctgtcacccaggttggagggcagtggcatgatcacagctcactacagcctccaactcctgggctcaagcatgatcctctcatctcagtttcttgagtagctgagactacaggtgtgagccaccatgcctggctgctgccatgcagtatgaaggagatagcctcatctatgagtattcttcaaaatgtgtaacctgaatcaagtcaagactttaggtgtgtaggctatacagaggatggaggaacaagttaagccactttaaagaaagaatcaaaaagtctagaactggggccttctataagacaggcttagtacagtacaaaaaagtgatgaagaccaggactggttttttttgtttgtttgttttgtttttttttaaggcctggccttttaaaaaagtcaatagcatgagaaaaggggaaacagggctgggctctggattaaaaaagatggacgacatgacaattgtcacatgtgttccttgattagattcaaaattggaaaaaaactctacatatactgagttgatcattatacaattctacatgcattgaaacatcacactgtactccataagaatgtgcaattattatgtagcaattataaataaaaattaattttaaaacagtatgttcttaaaaaccctataaaaccatgataatcatttgaatatggactgcgtattatatgatattaaggaattactgtgaatttattaagtggcatatattggtatttggttatgttaaaaaggtgtcctcatttttttttaaatgtatgctgaagtactggagggtgattgattttaaaatggtctagcaaccacaaaaaaacagatgaagcaaagatggcaaaataataacaattattaattaaatgtattgggttatgggtatgcattgtattattttttctatttctctgcatgtttgaacatttttatgataaaaaggtaaggaaaaaaaccttagcttttattagttgctaatgaaaatcaggtgtttcaaaactaattagtttttctctatccatttggaccagatcacccttccaaatgagcaaaaaatttaaaaataaaataacatactgataatttttaaaaattaagcacaggtgcagccctcaagtgtcaacaacagcaacaaaatggcaataatttaaaccacatcaatttccctttaattatctttatcttatgagatacaaacaaaaatttgcagtggtaacagtgtctggtgtttatgtttaaatccatataaattggttacttgctgttcatatcagtgaatggtttaaagtgaaaacaaccctggtaatcacaaattatctgttgtaatcaacttttccacgtgagttaattgaagcatagtgagtaccaataagtaaaaagaaagctaggcttagggaacagttcacaatttataaataattatgccacttagcaaattagtaaagtaatttactcctcacatctacaaacccttgaacaacacaggtttgaactgcgagggtccgcttatatgtggatttttttcagtaaaagttacattaagtgtgtctggctctcctgcctccccctccacatcctccacctcttccgcctctgccacccctgagacagcaagaccaacccctcttcctgctcagcctactcaacttgaagaggacacggatgaagacctttatgataatccacttccacttaatgaaagttaatatattttctcttccttgtgattttcttattaaaattttcttttctctagcttactttactgtaagaatacagtatataatacatctaacacaaaatatgtgttaatcagctgtttatgttatcagtaaggcttccagtcaacagtaggctattagtaaagtgtttggggagtcgaaagttacactcagatttttgactgcaagggtgtcagcacctctgacccttgtgttgttcaagagtcaacttttttttttaatcagcctactttcctatctggatttatgtgtagagtatatggattaaattaaatatttatattttactgtatacatttgacttacattatcttgatttggtggttgagtgatcattataaaattgctggaattcatttcctgtaagaataaagtaattagcagttgggcataatggaaatggcatgggactgggagttataaaacctgaatgatataggccacacttatgtgcttgtgtaactaaataaatatctgtttgactttgggcaaatctttagtcttcttgagtgttaatatcctcatttagatatatccatggttagaataggttagagactcttaacttgggttggaaggatccacaaattcccctgaaattaacatatgtcatgtgtactagtgtagaagcatttttctgaggggaagtgtggtaaattagatacagtcacaggtctttgcagtaacttccatctaaacatactgtcttttttcttgtccattgatctgggctggccttgtgacagctactctgtccaaaagaatgaggcaaaggcagaagcacagggcacagtggctcatgtctgtaatcctagaagtttgggagactaaggctggaggaccacttgaggtgagaagtttgagaccagccgtggcaacaaagcaaaaccctgtctctacaaaaaattgaaaacttagccaggtgtggtgatgtgtgcctgtaatcctagctacttgggaggctgaggccagaggaccacatgagcccaggaggtcaaggctgcagtgagctatgaatgtgccactggactccagcctgggtgacaaagtgagaccctgtctcacacacacacatgcacacacacatacacacactatattatatatttcatatatattttttatatgttatatattatatataatatatattaaatatataatacatataatatattatatatgaaatatataatatattgtacatattgtatatataatatataatatattatatatttcatatgtataatatattatataatttatatgtaatatatttcatgtatattttatatataatatatttcatgtatattttatatatattatataatttatcctatatattacatatattttatatataatgtatattttatatatgaaatatacatatgaaatatataacatataacatataatatattatatatgatatatattatatgatatatcatataatatatatattatatataatatatgatatatcatatatgatatatcatatatgatatataatatatgatatatcatatatgatatattatatattacatatcatatattatatattatatattacatatgatatattatatattatatgtaatattatattatatattatatattatatcatgatatatattatatattatatcatgatatagtatatattatatattatatcatgatatatattatatattatattctgatatataatatattatatattatattctgatatataatatatattatatattgtattatgatatataatatatattatatattgtattgtgatatataatatatatgatatattatattgtgatatataatatatatgatatattatattgtgatatataatatatatgatatattatattgtgatatataatatatatgatatattatattgtgatatatcatatatatgatatattatattgtgatatatcatatatatgatatattatatgtgatatatcatatatatgatatatgatatatcatatatcatatatatgatatatgatatgtaatatatataatatatataatatataatatataatatatatttcatattacatatgttatatatatttcatataatatatgttatatatatttcatataatatatgttatatatttcatatataatataaatcatatataatatattatatattttatataatatatagtatattatatatgatatatattacatattatataatatattataatatacatatataattataaatataatatacataatatataatatacatgatataatatataatataccatatataatatataatatataatatacaatatataatatataatatagaatatagaatattttctacattatatataatatataatatattttctatattatatattatatatattttctatattatatataatatatatttatatattatatattttctatataatatatattttatatatcatatattttctatgtaatgtatattttatatattatatattttatacataatatatttaacatattatataatatataatatatattatatattatatattatgtatattttatacattatatattatatacatataatatatattatatattatatacatatgatatataatatatattatatacatataatatataatatatattatatacatataatatatattatatattatatacatataatatatattatatattatgtatattttatatgttatatattatgtatattttatatattatacattatgtatattttatgtagtatatattatatgcatgtaatatatattatatgcatataatatatattatatattatatataacatgatgtataatatatattatatattatatgcatataatacatattatatattatatgcatataatacatattatatattatatacatataatacatattatatattatatacatgtaatacatattatatattatatattatacatataatatatattatatgtacaatatattatatataatatatattatgtatattttatatattatatattatatacatatataatatacattatgtatattttagatattatatattatattatatattatatataatattatatatattatatataatattataaatataatatataatatattataaatataatatataatatataatatattatatattatatattatataatatattatatattatatattatatattatataatatattatatattatatattatatattatataatatataatatatcatatatattacatataatgtaatatataatatattatatatattatatattacattatatgtaatatatatgatatattatatataggataaattttttttttaaaaaggaatgaggcaaaaatgatgtcatgtgacttctcagccttggtctcaagaagccttgcaagttttgctttcattgtctaccaagtgaattagtcactaccaagtaaatcagacctagctgtcttgctggaaacacatggcccagctgacagccaacaacaagtaccaaacatgactgaggctatctgggccattcagcctcatgtaagccattagatgactgaggctgcctgagtgatcccagacaaacccagcagaagaactaccagctgggcccagcacaaattgcagaattacgagcaatttaatggtagttgttttaagccattaagttttgcgatagtttgttataccatactatctaaccacttcaagaggatacatagatttttatctgattctcaaagattatgaactactactgaagttgaattagattgttaaaaattgtggctgggccctgtggctcatgcctgcaatcccagcacttttggaggctgagacaggcagatcacttgaggtcgtgagtttgagaccagcctgttcaacatggtgaaaccccgcctctactaaaaatacaaaaattagccaggtgtggtggcacacacctgtaatcccagctactcgcgaggctgaggcatgagcatctcttgaacttgggaggtggaggttgcagtgagccgagattgtgccaccgcactccagcctgggcaacagaatgagactctgtctcaaaaacaacaaaaaaaattgtatgattccctgtctctctactctcttcataaactatgtcaaaggcatgatttaatttagcaaatcttgcattcaaactgcattttaaagtaaatcctagaattatgtaactgaagaatcagcaggccctggagtctgtagttcagagaatttctcttctttcctcttgaaaaagtatgttgggcagtgtttaggcatctctttcattctccatattttttaaagattaaagcaatttcatctgaaacttctatttacattttggtttgttatttccaggccagtgtttaaacttatttatgacagttagaatctgctcctaggtgattttaaccttaaattctttcttaccaaagagtctgagagtgttccattttgcatccttcaccactgacataatgccatcacagctggccatgtatcgtaggctttcttgctttggattcaaacagcccttttcatcatctagaatgttaacctccttttaaactttctgactcttctcacatattcttgacagatttttttttccatgcttgtttttctagatcagcttttgcatttaacacacaccatttaaaaatatatctgatctcagcagacagcttcctacccaaagacactaaatctttttggctacctccttcctttttcttttcttcttcttcttcttttccttcctgcgttggaccatttacaatagtagcatcagaattttattttgaggaatctcctctgcttctttttggaatctcagactggggtgtcaaagtcaagcttttataatttcctgaaatatttttaggctcagactaacagagtgtgtgtctggcagtgaccacatccctctggaattttctgatggccaggtggccctcttccagggttcctgtcacttctgattttccattcagggcctccttgttggccagaattagaagcagggtgttaatcctcctcctcacttcctctccgtctcccttctgaaagatgaaattatcatttgggttactgattcttaccctggctgcacattcaaatcacttggggagcttaaaaagaaaaaaagtctgaggccccaccctgagagagtctgctttaattagtatggggtggagcctgcctgtcaattttttattttaaattctgggactattctaatgtgcaggcagggctgagaatactaattgaggcaaatcatggacttatcagatgttctgaatttaggaaatgagacatctggcagatggctggatagttgaagctctcaccattaagattttgaatgcctcttttctccagtccattacacttcaacacaagcaatctagttctagcatgtctaaacaggataatgacaaccagaaccatgatattactttctgattgttgatattaatctcaacacagctctaacatcagtaaacaagatgaagctagacagcaaaagtcctttgaaaatctcagaagacatgatttgggacattagcttttctgaaattccaaataaagatgaaccatgttgctcttgatgggtttccttattcattgagagtaatttgacaaaggaagtaaatttaaaatgagaaaataaaatattatttttcaccttttttagtcagtgttcaggatgttaattcttagacaaaaggcaattgagatgtgaaatacattagaattttttaaaattccctctcagcacatatcatatacaccacatatttgggctttttttaaattttaaatttaagttgttaattatcatcaagtatgcaaattcaattttccataagcctatttttctcctttctccatagaaatggcctattttggctgggcatggtggctcatgcatgtaatcccagcactttgggaggccgaggtgggcagatcactgagttcaggagttcgagatcatcctgggcaacatggtgaaaccccatctctactaaaatgaaaaaattagctgggtgtggtggcacgcacctgtggtcccagctacttgggaggctgaggcatgagaatcgcttgagccccagaggcagagttgcagtaagccgagattacaccattgcactccagcttgggctatagagtgagactctgtctaaataaataaataaataaataaataaataaataaatttaaaaaatggtctttttcttgttagtggcagagctgattttggtgttattttctgagctgagctaagtgttggctaaactgggacatttaggaataagtggcaagtcctccctacagtcacgtgactcaaaatgagcatctcttcaagggaccctgaacaaggcacagctgcatcatggaaatctcagtccattctgggattggccaagcatgattatttaacttggtaggtgatgttggacactatgggcatgcagggggaaatcagcctcttatgaattacaggtaaccatggaagaacatgaggatgtgcttttcttgaatgttcactcaaagaacaaaaggcctagaaatagagcgttctaaaattctagttcttatctgctctgagttagctgtgtagaaactgctatctggggacagtcaaagttcagaggtatggtctgcagaatccacaaacacataggcaacagagaggataagcaacttgttcatgttgaaacactacaactgctttcaatcaagcaggcccttttgggatgaaatacattttgtcaataattcagttttgcaaatgttttgcaatatggtttcatctgacaaaccctctcagtggtgtatttttccactttccaaagaaagcacatgtagaaaaatgatgtcaaataacattaatgagtgtgttttgaaactgtggacactagggaagctagccttggtccttactccaactctaactcatgccatcttgagctaggattactggagtttgaaaacaatgcatgaaaagatggcagaatgaaaaagagtgcttgacaaaacatgacacagctaatagcacagtgaagacagctgatacaacgtttcttaaagttggtgggtttaattcagactgagtgttattttaatgtctcattcattttacatggaaggacatacctaaatatacacaattatttcatcatccactgccaaatatcaacactgaaaacaatgtatgcttttgttctgtttcagggcaaagataatagattcatgcataagtgtttacagaagctttttaaaaaataatcaagttatgtttctgttcctaccaaaactgtgcagtctttctaagcaattctgttgacttcctggagaaaagagaagattcccactgcttcaaattaaggtccacatattagcagaggaattattggttatgactaattgaaaacagatctaagtttcttttaattagaaataagtacattcattttataaatgatttgtcataaggagagcaatcatgttcacatctgaagtatacttcatgagtccatttttccacttctttcctcagtagttcaggaaaaaacatatgctgcgtttctaattttttttttttgtttgtttgttcatttgttttggttttacaagcaatacaatcaatcttctgatttcatcctaaaatagtaggcattcctactttggtacaattcaaccaggattgcacaattgctgggatcaaaagaagaagacattctacctcttcacttgaactgagtcagtgtgaattaattttaaatgtcaaactagatttagataaaacatacttgaaaaaccatgctgtttgcttaagaaagaggttaatgaggaaaatgtaatccccacttgaatgccattggaatgcaaaaccacatttatttgcatgtgtggtatctgtaaaaggtccaaggaattttgtttttggtgttttgaattgtttataatgtattctctttttattccatctactaacaattcccagaaatgatggaaataaaaagacggaaaaatataaatgcatttgggttctaagaaaattaccagctgcaacatcagttctagccacagttcataaagcaggtgattatggggacaataaagaaaatgtcattaaatcagaaaaatcccttgaatcttgccaattccatgacagtgcctagaagtctgacgattctaaattgtccacgccaaattttgcaacaaaatttcactaataatgatgctcatttgcaaggatttagtttagatattccaggctgcaggacatgaaacacactggataattttctttgacattatggcttattaaatcacttcccaaagtgtcaagtaaaacaaaacctattcttttaaaagcaaccctggaagggtcactgacttttcaatagaccagtttctttttcacttttaggttaatttctcacacatttttggttcaggaattgcttcattaagaacactggatttcaaaacaaccccatttccctcagaggcccaggaaccagaaggcagctcagcactggaagccacaggccaccaattaacaacaactagccaggccctgcgggtcatggacattttggcagaaagttggtcatattaatgttcaggccacaagttcccatttcacgtggagttgctgcccgattgcaggaaagtgctaatggttaggattaccattgcttaaacttttatttcaatgccttgatctgtcacttgactgtttccccctaggctttaaaatatgcaagaataaaaatgaaacaaaaattaacatgtttataacctctcctaatatttctatttctgtcatgttctccaagatacaaagagtaatacagttctactgtaactaattccctctggaagcctctattgccctggactaaagttttcaggggcaggtcttgctgtggagttaactccacaggaaaggagtctgcccagtctggtccctcctgtggctccttctgaaccaagtgtcccgtcctctccctgccctgggatgtgggacctgccctgcaggaggaggcctgtagtgtcccattatgccagggactgggtggctaacagctgatggagtattcacaggcattgcagcaactctctcaatctagctcttatcagtaatacagctgacatttttaatctgtcaatctgatccctgtcaccaaactctggctgggatgagaggcacactttattaggcctcttaaatcctaactatttcacagaaataagtgaactaatacagaattctctctctctctctctctttttttttttttttaacagttttagcaacaagtccatcctggtttcctgtgccccactgcatgcacatgatctttgctccgggatctgggctgatgagtcacttctctgtatcgttgctgacatggtggtagagggactaaaaaccaagggcagttgtttccactcacatttcactgctgagtgccagtcatatggtcacaaccacctgccacagagtgggaatgtgtactcctcctgcagagatcggtaccatgtatttgtgagcaatgttaacagttaccaaacaattccctctggacaaaaattacttaagtggcatatattcagtcttatctctgctcaggaacaattgaagagtcaaggaatcagctcctgagtaatatctgcaagtacagggttctaaggtggggtttagacagcaaggtgggcagaggaaatgactgtaatgttgcagaggagatgtgcaatgcccacccagctctccgcttgcactgaacaaagctgactttccccagtaacttgtcattcaaccctcaggctgaaaagtgaaaactcaccatcttaccttaagtagtttagtgcctactggggagtgaatgtccagatataagagcgtaaactagaacaaggctgggtgcggtggctcatacctgtaatcccagcactttgaaaggctgaggtgggaggatcacttgagcccaggagtttgagacaagcctgggcaacatagtgagactccatctctacaatttttttttttaattagctggatgtggctgcatgtgcctgtagtcccagctactaggaggctgaggcaggaggatcgcttgagcctgtgaggttgaggctgcagtgagctgtggttgtgtgactgccctccagcctgggtgacagagtgagatcctgtctcaaacatttttattttaaataaaaaaaagaggacaatataaaatcaagtatcaaaacaggcagaatagtcagtcattgagccttagcaaaaatttttgcctaaacactctaaaaagttgctgtttttcctcctttggtttgaaagtcagaaaaagaagcagtgaggcctcatggtgaaagaggcagcatgagagccatccagaatgtttgtcccttcagcctcctggttggggattgttgacgacctctcctggattggactcattcccccaccccaaaactacccacagctgaggacagccatctaaacacctgcagagtctacactactccatgcccacactaatccagacctcaggcatgaggcacccaagcaggcttgtttcctgtgtcagtcacggttcaatacaggaaacagaaaactctctagatctgccaagatcagagggatttagtaggaggtatgaagtggaaaggctggaggagtagagtcagcggcaaccatcagagccccctacacccacgaggctggagactagacagtgggccatggagtctagttagtggcctaactggccactgcccatacttatgtctcccagagccctctcgtacacctacacagctgaagagggagagcagcttcctttgtactgcctttcaaatcctacgtgaccgcacttcatgatcagaacctaaactgcatcctgatctcttacagcaaagtgactgggaattacagtttttacacttctaggcctgcaatacagggcggtggggaaacctaccaatgccatgtgctatggacaagaacaaacacactcttctacagggattgacactgagtcacaggccttagtggactaagaacagggtgccccagtacacatgctctccccagtgcctctccctgggaatctcactcaagatgggaagtctcagaagtaaccgagagccgtgttgttgtttgagtcactgttattacggtttggctctgtgtccccacccaaatctatctcaaattgtaatccccacatgtcaggggaggggcttggtaggaggtaattgaatcagggggcagacttcccccttgttgttcttgtgatagtgagttctcaccatctggctgagatctggttgtttgaaggtgtgtggcacttcccccctcttgctctctccctctcctgttctaccatggtaagacgtgcttgcttccccttctgccttgattgtaagtttcctgaggactcccaatcatgcttccttgaacattagggcattgagaaattaaagaatttaggagcactttcatcttgcctgccagtcatcttcccagtacacaccctgggtgtggtggcgcgtgcttgtagtcccagctacttgggaggctgaggcaggagaatcgcttgagcctgggaggcagaggtttcagtgagccaagatcgcgccactgttctccagtctggtgacagagcaagactcagtcagaaaaaaaaaaaaaaaaagcagcattagtggcacaccgtcatcactattaatgttgccgagtgctctatgtgtttgtgtgtctgtgctcctttcatttcagtaaaaatcttaaaattgccctctattctcttagtagtctagtgaataaaaaatacttttattgaattcatcttaatttcagatttggtggtatttgcagcagcagcacatgtggatggccacatttttattaccaagtcttttccaagtttcaacagcgtttttgtttgatgattttggtttaaatccagttaatcaatataatagtaaaatgaggttctcccctgtccctgttaaataatagtagttcaaagacaggaaatatttaaataacaaaatttgaaaactgaaatgcgtgccttctagaatagattcctaccctcagctgtgagaacctcaaagccgcccttttacaactggagagatttcttcttctttataagtacgcatatacttggttacttaggaacaggccacccacacgacacagggagacatgaccctgcacccacaggtacgtgcacacccaggcgcgagtgcccaccggccccacagttcgtctgcaacagtcagattcaagatgcggtagattggcaccttaacctcttttggctcttcttcccccgaatcaaaacccactgtaaacaccgcgaagaaccaggaaacttcacggctttaatcatttcctttccccaagctccatgtggcacacaggacattccgttttcctttagggttgccgtcatcctgcgacaggtgcggaagaagaaaaaagcaaatctatgtttccaaagagcggaggaagcagagacaatgtgccaacacggggtgcgctcttcacctttacgctccactcggagcaagcaaggaaatcctccagctctagcaggggttgagggttagcgccacctggctttctaaagaagaacaagaggcaggaggtagatgaggctgaagaggagcccgcgccctcctttcctccttgggcaccaggagggcgagaagaaggacccgggagctcttcgtttcagagcccagggcagccaggctgctggccaccgcgcactgcgaagagacgcaattacccttctgggaatcaagaaatccagaaacgtctcttggtactggtgttagactagtggattccacatttaaggcaaccgtgaattgcagaaataactgcggcacttaaagtattataaacaagcaccgatcaatttacgcattgattggttctggctcgtttctatcaaccacctattctgcgtaaacttcttataccggctgagaggaaagaaaaagaagacaggagaaaggccatcctaggattctgatctgtctgtggcagcgttggaaaggagtcaggttaaatgaataaagccccggagcccccgtttattcacatgaaaaatagggaaaacagggccttcggtaactgccccaagtgattggaaaatcaaaggaaaaactggcaggagagtgccttagacattaccatttctactgtattattgttttattattatacgatatcgtcgtattagtcatagtgaaaatggtaatcaagttatcattatccattcagtgccttatacatttgcactgagtttgtatttgcacatatggatataatgaattcacagaatgactattaatttgagggcactgccacaaactgctttatctagaacttggaccagttgtcaaaaagtaattacctatttcggcatgacttttaaacggtgaaatctagagaaagttgtttggaaactgcctttccatggattcagtcaagaacacaaacacagatgcacagatgcatataatatgtgcacactatgtgcgcatatgaaaatgtgtacatgcatgggaaatatgggtttgcatttattataagaatgattcatgtacattgctactctgtttacaaagacttttgcattcacttttcatttagtcctcacaactttaggaggcattgctaatccccattttacagatgaggaaactgaagcatggaacaataactttcctaaaatcttgatgagaagttgtagaaccaaagccatgtattcaattctgtgtcatcctcatatccagcaaacatatcatggacaattactgtgtgccaggcactaaagcctggtggtcacaaaaatcaaagacatattccactgccttcaagaaactcacacctagtggagaaaaaagagaaattactcttcctgaaggatatatactccacaatcagcctggggcttaagtgaagacttcccaaaagagtagatgcccaggctgaattttgaaggacaagaatccttctgataaagatggagggaagtgtgacccaggcagaaagacaacatgtgcaaagatatgaaggcaaaagaaacgagagtattcaatatagctcagaatcacggcttaatgtatatatagggacagtggtgagaaagattataaagagcattattgaggttttcttgaagtctatgggggaatgaatgaaagattttaagtagggaaacaacatgatccaatgtcatttgcattaaagatcggtccagctgctgtgaggacagactggagggtacattaacagtaggagaaatgatggaatgatgcaggcaaaactcaatatttgtcatgctaaggtagggggttctttgaaaaaaaaaagagagggtgaatttgaaagatattaaggaggagctcattacagttgctaggttattagcctgagcaccaggtgggtagtggtaccagtcatggagactaagagaagagactattggtatgcaacagagactagaaataaattctgttttgagcatagtgagtttaaaaaactaaatacatctatgtggaaatgtcctctatcagggagttggatatgcagatctactgctccaagaacaggtctgaattgtagtgagataaaacactggtatcaactgaagccacataatgattaataatagtatttgcaaacaggcatcaagtacttactgtgtatctggcactgtgcaaagcattttagtagataatcttatttaatcctcacaacaacctcacaaggtaagtattctgattaagtattgcccagggagaaggtttaatataagaggtccaaaacaggaccctgatgattacatttatgaagaatggcagccaggtgcggtggctcacacctgtaatgccagcactttgggaggctgaggcaggcggatcacaaggtcaggagatcgagtccatcctggctaacacggtgaaaccccgtctctactaaaaatacaaaaaattagccaggtgtggtggtgggcgcctgtagtcccagttacttgggaggctgaggcaggagaatggcgtgaacctgggaggcagagcgtgcagtgagctgagatcacaccactgcactccagcctgggcaacagagtgagactctgtctcaaaaaaacaaaaaaacaacaacaacaaaaaagaagaatggcagaacttttcctactatattgcaaagctatagcacagtcacctagacttaaatgcagaaagctacacattgaccaccagttggctgaatgtcagctccatccttgctctattcctctctaggacaacattctggagtgactgccaaggctagctggcccattcccacactgcctcactgcctacctatggtccctcagacttggtgcgacttgtgggtttttttagcctccaagttgtttaggtcccctagcctgaagatgataaaggaaaagactacttccaggtagggaaaccacctgtttcactacacatcccgggaaaacatatcatgactgtttctctgaaatactttggattccagccagacagcattaattgggctagtcaaggtcaaccaaggccaggcaagcaggaggaagtgccctagacttaattttcaacatggcagagagtccttgagtcatctcctcacatcaagaggcagtccctgaaagcaagcaagcaaaaaaaaaaaaaaaacttactctttttttttttttttgagacggagtctcactctgtcactgaggctggagtgcagtggcactgtgtcagctcactgcaacctcagtcttctgggttcaagcaattctcctgccttagcctcctgagtagctgggattacaggcacccaccaccacgcccggctagttttctttttttcttaattcttagtagagacagggttttaccatgttggccaggctggtctcgaactccggacctcaggtgatccacccgcctcggcctcccaaagtgcggggattacaggcgtgaaccactgcacccagcctaccttactcttaatggtgagtaattcctactagcttcttcgccttctcccaatatccatcatttgggagtttgttgtgtgaagggaaagtatcagttgaatactattctgaacattggatttacttacttacataatttgcctctctgttaagtttgcctagagatttttgtttctcttacattgaattcaagactcttataaacaaatcagacttgctgctgtacttctcattagaggaactgaaaccttgtcccaatggcccttaagagctccacccaagtgaaatgataccaaacatttaagttttgctttacattaatgctcctgaacccaattttggcccagatatccctggtctgaatgagaaagccaggtaaggactgcagatgttggggatagggaggaggtagcctaaagacttgatccgtgttcacctaaacctgtcaccaagatttgtgggccacatctctgtgacctgaagaaatcagttccctgggccccagcatactcatctgtgagatgaaggggctgaaacatctctaaagctcattccaagtttaacattctctgcggacttaatataagaatgagcagggttccagtgttggctttgctgcttccatatggtctgggtaaggggctcattgaatgttgatacattacagcatcagagaacatgagattagaaatcagatttactgaccaaacagatcacctagattaaaaattaataatacatctgtatatgtatgtatatgtgtgtgtgtgtgtatgtatagatgcacacatatatacacacggagagacagatagagacagaaataaatatagagaaactgactggtcaagatagcagtgagttgatggcaaagccaggtctaaaatccaggttttctaactattggttatgtaatttgcacacaggtctctgtgtatgtcatgcatgccactagaatgctggaagatttggtaagattcatgtttaattggctccatgtgtggtgtgcttccttcccccaccagcatcaggattgccttagaaaaggccgcgggttctggagacagcatggatcttctttcaaatgggagccctaagaattcacccctgcctttaatattaattctgcatgttaattagctgaaggataacatcctcagaccatttttcagaggtgatgaaaggagtccatttaatcgaagaggctaaaagagatgaaattatctggactgtcctcccactgagggcaatgtggggtaatgaacccagcctgcactaggcatgggaaagaggacacctccccagctccatcctatccgtgttccctgagcaaatttcacctagaaaaattacagaagcaaactgcctaaacttttagccactgtcctctgcctctctctgctaggtaattttaaaaactgggatagtggtttagataacagtagtagtaatagtagtaataatagtaatagtaatagcagttgataaggaagaggagctttgcaaatgaatcttgcttagactgaaatttaaaaagtggtttgacaggctattgccttcacctagttcagtatattcttcagtaaatatttagtaagggtctcccccacccactactgaacaatgtgctaaggcctgggaatacaggtagtgtaccgcctggtccctactcccgcccatcttcaaagtcctttcctaggacagattcagttcttgaaaagcctcattgatggcctccatgcagcagccaactgcctcacgtgaacgcaagacgccctaggtaacccgagccaatggctccctcccatttggggagaaaaaaaagtggggggcagggatcgaaagaaaggaaaggagaaaaatactgagaaacatgttttggcaggccaggccttcagagactaccatatgtgctccatattgagcaacaccgggtctttgatgtttttctgaatgtaaaggcattattctttctcaaactgcgcctaagtactacagacattaaaacaatgagacgtaacgggtggacctggctctaagtgtttaatttgtccttcacccaagtgcctgccaccggttagctccccagtttgcacccaggcagctggcagggttgccatcctctctggccccatccccctttgagattcaagtttgtgtgtctcctagaacaccttagcgccaagttcggaagtaagtactttcccaaagccctgcgaaaacgccccagatgtttcctgcgtcacggaaacaagcccaggttggatctgaagcattcttacgacggtgggtcacagggcctgccccgcgccagcgagccctgctcccccaagagctgcggggtgcacccggaggcctccggcgctccccgggttcgcgcccacccctgttcgccggggagtggccaacagcgcaggaaatacgggcgaaggagatgcccattttatttcgtgcagaattctgaatcaccaacgaagacccttagtaaattttgtgtgtgtgtgtgtgtgtgtgtttgagacggtctcaaggcgcgttgctgaagctggagtgcagtggcgcgatcaaggctcgctgcgctgtcgacttcctgggctcaggtgattctcccacctcagctttcggagtagcttggactacaggcctccgctaccacgcccagctaaatttattttggtattttttgtagagatggggtttccccatgttgccccaggttggtctcaaactcctgagctcaagggatccacccgcctccgtctcccaaagtgctgggagtaaatttatactgtaaatttataaatttatacaggccctagtaaatttatactgtaatcttggggagtttattaaatagtcactctccccgattgttaatttgtccttccctttacgtccttctacccaccgccggagaaacggcgatcttaaaagcaaggatctaaatccactcgaggtctctccagggaactgcgctctccttccggggagcagaaggccggggcttgcccaaagtggggaaacccagaggcgggaggctcccagtggctgggcaagagcggggtgcaaatgcgaaacctgctctcggacgccgtgacgctttgcagactggggcccctccaaagtgggcggagtgaggagtgttggccctggagagcagggtgtccgagctcccgctgcttccgggtctcggcaagcacttccggggtgcgagccacgcggcccgagctccgcgcttaccgattatcacaaatggtgaaggagattggcgccaaaagggaacagtaacaaccgtggccgataatgacgtcgggattggctacaccagggccccctctagtcacggtcaagccctagttttcaagcacttctgcgtttgctctcggccgccccaaagatgggggattcttgatgcggcttgagatgccctgggaagccgcaaagcctggaatccaggagcagcagcctcagccttcccagtgcgcctgtggttgcgggcaatggggcacagccctggctccccttggactctcagtaggcacacgaagaacggcctttctgcgctcaggcctctgcggaggtctctttcagggtcgtttggggtgtctggattcagaagggggggccgggctctccctgaccctagagggtcaggaaaggattactgtcgggcggaggtcacagtgatgctctgcccttgttaaactggtcagctggagcgggctccctggatgcagaggcatgggttatctaggagaattcaggttgtgtttgggcgctaggttgaaggtgcgagccgttcctcctgaggtaatctcatatgtgaggcggaaatgaactggatacacacaggaaccaccgcgcgtctttgcatccaattattcttaaacaattgccccttctccttcggagcatcccttctaccaaccaggatctattgtctcagcacctactttgtgctcagatctttgccaggttctttgggggatacaagaccacggaaagccaggtacctgcgcgtgaacctagtgagactggtgcgttaatggaaggaagggagggcgcccattaaaattacttctcgtgctgcacttttttgtggaatgaaccaaaggcatccggagaagaatatagtattgcacgcctggacttcggactcagcttcctttttctgacccttcctcaacctggctttccctcttcaggaagagatttggaattccctttatggtggggcggggaggggtggggaaacagccagcccaggtaagtatgtgagccacatggtccgcgaatggaagaaaggaaaatcatctccaaatgcaaccaggcaggtgggggtagtttgactctgaaagggaatgggaaatctgaataaccccgaaggcagcagactccatacccggtgttgaggtgtgagaaacagtcaacatttggagccctggagtcagaagatttttggcagctgttagataacttcctgatctgcaataaagttcatgtgacggagaggatgtttccgctctccgttgcctggctcctttcctttctaagcctgcaagtttaagagattttaccaggtcccacttgaatggtggcctaatgtgggccctgggaggagtcctggtggcctgaggctgcaaagattggatcaaacaggggcagtcacaagctcactggcctgttgcatccccagctttcacctgccaggtgacaccaaggcctccctttctcaaaatggggaatccaggctgctccattttcagacaccaacctgtctgttcctgatcctccccacaaggtccaaacaaaacagtttttaaagaaatctgtgtaaagttccaagcgtcttccacagcccaggtgcactctggctgcaacagcctagtttctggaccatgatcaggcataattagggtctgatcactatagaaatatatgcaagatgtttacttcccttagtggaaaaatagaaggggggtctggtgcacagtgggactcacgaagaaggagtgtgctctgagagcacctagcacccgtggacctcaaacccttctcagctcagggaggggcagtggaattcaagctcaggtggttccctaccgaccaggtccctgggtacgtcccagggctctggcacagctagagcaggtgtccacctctcggtttaggccagcttgaccctgtgtcgttcccactcccaagcccccagtcatatacatgaggactggcagcaggtgggcaggagaaggtggtgttccagctacatcttggagtttttgcttgggatccggccagcttcagggaccatcacttgtggggagggttggacgtggacttcccagctggatgataatagaactggctgaagagcagaagccagaactcaaggttcagaccttgtccaccaaagtcagagattgcagatcaaagctattcaaaaactcacttgtaagaccagagagaaggacgtgaagttcccagagtccagggtcttggggtggggaggggagtgttgcaagggtaaacagctggcctaggaagctacacctcgccatgcatggtgagtgttgaggggagatggcttttcaagtttttaggaagaaaatagaatttccgaagacacaaacacacagcaatgaggatatgtgacaaatatccttgttttgcaaaggtataaaggaggaagtcaacatgctggagaccacaaagtcagtccagaagccaagacccaacccagatgtgcctgactctgaattgctttaagcacttgccactcagcctctgataagcagcttaagttacatcttcgcgatgtccctaattctatgagtggtggatctgcccaaactcccaacagcttttaggagggtgtcatttgtagcaaagtagagacttacaataaacctcctgcaggggaagaagcggggtgcgtggggatagtaagttttcttaaatgtgccagaagtgtcttctattttctgcccaccataagcacggtgtagtctaattgtttccagtaattgcattccagtcctgcacaactgcaaactctggagcaccgaacccactcacgagcaccacttcctccagcactcagtggatgcctaagaggcgactgtgaccatgttcgctggtgcagtcccccgctctcagccttcacacaaagtctgaactacattggttttttttcatttgaatccatttctttttggtcttggcttaagaaatcactctggtcattaataactgtaataagatcactctggcccaagtcaccagggatggcaaggagcccagaggcttccctgcatgcagcgcaaacggcgtgctcctccggtagccgtatgggggaggacctataaggtacctgccagcacagcctggggcctttcctaccccaactcgtcaccaccgctgcctccagctttccctatcccagccccagtgggtagaaccagacaggagactagacctctttgtctgcaaatgtgggactcccaggcaaaagaagctcagaaatattgaataaaggtattggactctagaaaccacgtggagaaatctggtgtaatggaggcaagcagttttagctatggttgctgcaaaatatcaaatgcccttcaaattttgtgcacaattatttttattctcttttcttaatgtttcttttaatttttgtcttgaatttcttgatttttagagtagttgccagaccactggagtccctgccaggagaggagatgtcactgaaaggtcaacaccatccttctcagaggaggaaaaactgagttcaattcacattggcagcctaattccagccccatgacccagggggatcatcctcttcctctaggggttcctaaagtggaatgtggtgccctagccacagctagcagcagaaaccatggcagaggatggtagaggagagagaaatgcatgaatgcagtgccactttctgaattttgttttcacttgtctgtcagccttgattgtcaccactgaattagatgatcaataactgtaactgaagaagagaaatcaccatagtctcaccttctgtcactgtaatgactgtaaaatgaattagtataaccttgtaggggttaaaaacgcccattaaatgaccactcatttagccacctccaactttagaattgcccccttcaccagagacaattagggcctagatgcccaaaacccaggaaatgcacctgacaccccctagaacatcatttccatgtccaaagggaaagagaaggctcaacagggatgagtgtggctttcaggactctttaacaacaatttatcctcaatgcccacctggagtcagtgccctgtagagctgatggcccaaaaggcagggatgtggggttcctctccacatcccttgctcggccatcagtatattgggacatcagtacaagattcttgtactgattcttgtacatcagtacaagattcttcttgctcagccatcagtacattgggaaagtgaagaaaaagggaaaggggagagtagctagacagcggagaagctctgtgctgggattctgtctttgtaggagaaaaaatagggggaaatgtctgcccaagcaactcccaaaccacaattgcctcctgccacaggcccgaacactcctttcttgcttcctaggtttgcctgttctatctcactcctcctaccttctgcaaatttttcaaatccataatctaaagcattctctctagagtgtaagcaagcagtcatcagacaacctctctagatgagaaagaaggcgtgaagcaacggctgggaggtggaagcacaaataatgatgtttggaaggtggagctcctggagctttgctttcaaaggttaacacgtgggtttccagagctccacacttcgttctttcccagtttaagggtgggtggtcccttctgctcacgaaataaacctctgacaagtggagaaacggctgaggtggcacttggaagttaggaaccaagttaatcctctcctaggtttccccgtgcttctaagcctgtgttgtccccgcccgggctgaagggggagctctgggctcaatttagatggtgtgagtagacactgaagcccagcgaatttcagtttaaatctcaaaccctggtgtggtgaggcaagaaaggtgacacttgagggacacatgtatggtaggactctggactcctctggttgagtaagagagtcatggtaactttgactttcctgtgggtattttagaggaatagggacgtaggccctacagcttaaaatagtgcccaaagtttcaattccttagaaagggatttcccatcacttaaatcaccctctaggagtgtatgctagaggctcgtggagggcagtgcagccccgtctcccaggttaccaggagacggcccaggctgcagggcccctcagtgtgccatcaactcctctcatgcctggaacttgtttgggtgcacagatctacagccaggtctgctctctttgcacctcaattttcttgtaggcacagagacaggaaatgcccttcttacagtttgtgaagattaaacaataggcagcctgtaaaatgccttcgcacttaatatgcgatcattaaaatcagttccttccctcctgtcctgagggtaggggcgggcagattttattacttctcttttcctgatagcagaactgaggcggggttgtggaggagcgacggaggaccacctctaacttcccttcacttcctggatttgaagcctcagggccaccggcctcagtcctgttacggtggcggactcgcgaggttttccagcagctcattccgggacggcggtgtctagtccagtccagggtaactgggctctctgagagtccgacctccatcggtctgggagcgagtggttcgagttcagatgctgggaaccgtcgcttctccccggccgggctcgctgttttctcctccgctcgccgtcatcaagcccggctatgagcagggctttaaatcctccctccctcacccgcaggtttaccgagcagccccggagctctcagacatgctgcgctgcggcggccagaggaggggtgggggcattgccctctgcagcctagtgcccaaattgccactcatccggtctggtgccatgaagggaaggccgcgagatggtgctaattaagaaggccagactctactccttgcacaaggtccggagcatggccctgtttttctgtttgtttgtttgtttgtttgtttgttttaagacagagtcttgctctgtcgcccaggctggaatgaagtgtctcgatgtcggctcactgcaacctccgcctcccgggttcaagcgattctcctgcttcagcctcccgagtagctgggattacaggcgcctgccaccacgcccggctaatttttgtatttttagtagagacagggtttcgccatgttggccaggctggtcttgaactcctgacctcaggtgatccacctgcctcggcctcccaaagtgccaggattacaggcgtgagcctcccggcctggccctgttcttttaaaaatagccgatctaacttcacactactaccaaaagccagatctgtccccaagctctttcttcccacatctcccctacctgcttgaaagggggtgttaagacctcctccacacctgagcgcccccaccctgtggccgccaccaccagaaccaccatcaactctggaggccgatctgaggagagaagagaagccaacaaccccgcaggatgagagagcaatctcttttgtatcacagaccctccggagcagttgcgggagggctggctgggtgcatggaagtatttagcaggttcagtgccattactgcctaacagggtgtgaaaagtaatatgaatgtgaaatactgtgggaaaacggagagtttccaaagcaggcagcgaggcccctccgctggtgggcctggaaggccagaatccctgctgccccgagtgcggctcccggaggcgctgctactggccgaggactgcagagggaatgtcggggagggggagatggatggagggtgagatgggtggagggtgcagtccgccctgagaagagagggaggggcaagctggcagtgcctgggaaaagcccgagaaaagccctgtcggctccctcttcctggctgctaaagttgacacaagacggcttcttggaactccccctcctcccgcctaaatgtacagagcaagacttgaagtcaaaagatagatagcgatcgtgctgaaagtcaggtggaaaacaagactgctaattttatgaaacaacctatcaacccactgggaagagatgacaagaggtacatgggcgcttctgcaggaggtggaggtggaggtgaaatgccgaggttctagactgatgtaaatttctccaactaactccagatcgagagcctacaaatccgacaaatatgcccacactttgacagtaaccgcctcccagcacgccccaccaccgccaacacacatggaggggtttgaacttttccaccttccggacctctgcagtccgtcgcaggacgcccaaaccacaggccggacacagatgaagccagaccacagcccccgccccagccaccgcggtaggtgggtgcccaagagacttctcaggtgagggcaggggccccctgaaaggcactagagaaggcctgccgcccgaatctccccaagtgcaggggagaattacatttccccacctcctacccaacctgccccggccgagttatggacatcgccgcctcattctagacttgaaggcactctgcggccaccaagagaccactccgcatcctaggtcgagcctgtgggagaagcactcggggcccgggaggccgaggtgggaatgcctgctcttgggataagtgccgctacatttgttgggcggctttgtcagtttagaaagcttgtccctgcactctgacagtttctgcttgcagggccgggtgccgaggcgagatagccagcttccctgtttcttagaatatttccgtaaaccagactgcatccgagcagccgggtggtggtacggctggtagcagaaggtgcagatggtgccaggtttggaaacacaccccactgcatattattccacttcacgagtactaaggaggagtccagaattggtggccgtcctccctcttgttttctcatgcaaataactcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccccgggagcacgacggatagaatgcgcggggtcgagacggtgtcggtagcgggggccgcagcgctttgcaaagccggcctctgcccccggcctccttggagggcggtagcgggacctgcgctcgcagcctctccccagggctgtgcgcttcggcctggcggctgccgggcaaaaacctcatttatttccttccttcccgagtgagctcacttcctccccgcgccgctcccttccgtcggccggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttctctttctggccctcatttcccctgcttctcactttagttcactgctgttttaaaaattcatatgcgggctcatttaaaaagcaatttcacattttaaagactgcagcagcagagggagaattacaaataggattgatttaattagctggtaatgcttctctcatgccctataattaaacagaaatcctaatggcgtttcagggcccaaaagtgattattactagcatattttacatttacattaaaacgctgtccccggggtgtaatccaggatctggctccatttattcaaatttctaacctgagtactgaagccagaatactgctccccagcaatggaaggatggcgtgtgggggctgtggtttggtttgtttggctaattttaacttttgttctgttctgttcctaaggcctaaggaaagcagccgatggctcccaagacaactctgtccggccagtactccagggcaacttcaaccccactaggacccaggccaaaaccatatatatatatatatatatataaattaacgcaaaacagagccactttggtgcctacccctccacaagtaggtaggcacatccaggtagctctgtcagaagatgggacctggcgccttgcaggggtagccctatggagatccagaagccccgtttcgagctacgaagtctctcttctactgcagtcttctctccaacgtggagatctagcaacttccctccccctgggattccctgtgaatccactctagttgggatatagcctctctacagctcagtgacgtagcgcgccaaaaccaagtacccaccccggcaactggaagacctagctgtcctccatcccgcctccgcagtcgataatctccaggatccaagcaaagtgcctgtccacgttgtcaccagatccacaagcgcttttgatgagagctgctacccttttggaaacacgattccctctccctagtagagaagaatctattcttctgggctggcgtagacaaagaataaccaagataaagtatgtggtgtgaaaatatcagctgcctcttctttttttgtttttgaaacggagtctcgctctgtctcctagggtggagtgcagtggcactatctctgctcactgcaacttccgcctcctggattcaagcgattctcctacctcagcctctggagtagctgggactataggcgcccgccaccacgcccggctaattttttgtatatttagtagagacggggtgggggggtgtttcaccatgttggccaggctggtcacgaactcctgacctcaaatgatcggcccacctcgacctcccaaagtgctgggattacaggcgtgagccaccgcgcgccgggtggaaaacattagcttctaatagcagtcttggagtggagtgaagacgttcaggaagtggtggagataggcctgctcaattaaccggccccagatatcatttctctggctacctcttttctcgcctggcctggccctctataccgttttttgtttgtttgttttgttttgttttttttctgcaaaacgttttctgctgcaactttctctttatttatgcctttatctttcttaaacaagaggtccctggaaataactaactaaggaggggagaggaaccccctcacccccaatttcatgaatgagtgctacattcatgctggccgggtaccaagagcatctttagatctttagacctgagtcttctcatctgtgaaaaagaggttaaagcagatgaaccctaaaggcccatttccagtcttaaattcaacactttcaagacaaaacttttcttctgtattcctgagtgtgtatatatatgttatgtaatatatattataatgtatatatataaacttggcttagtaatgttctgtgctgagatgcagatgaggaggacattttaaacttctaagggtgccctccctctggttgtttcctcccagacgagcattctttgtggaacagaaagagatcctcagggtggaaagcaccagaggcaggtctcctgaatacggtgctgtccaagtctactcatggtcacatgattcattaggactgtaaatcctcatcagaacacaagcatcagactctctgaccctgccaattcaagtactaatggtaaaatcgtccaagaggctggccaacatatgcacacattaattagagttatgtgggcctttggcttccagtctgatgaacagctccagggatgcagggggcagagggtttggggtccttttcacccagcagatgccctttggtcctgagagggcattagtccaatacagtgggtgatctgaaagctaacccctttcagaggatggcttaacctcagcaactaggctaaaacctagcagtgggtccctaagagggacaggggaaaaaaatctgttcagaggaaatgagaatcagcagtaagcttttgttgttattacttcatcttgtattattatgagacaggagtggggagaagcccaaggtgaaagaagagaaatttttggtatgcatggaagacgtggatacttagcaaccctctcccctggcactcaagtgcacacgcagagaaagtaattgctatattccatctagaagctgaaaatgctttcaacaccatttacaaggataagggaaggagcagctgaggggagcatgggtttgattcaacttaactgcaattctggccaggtaccacaagtcacagagcatcccagagagcagaatcccagagagtgtcccccatccctggcaagggacactatgcatggcacttttcctacaagatgtgtccttttctccatccatatctaactcctatgtggaggagagtcaaggtcactcacagtctctattagacttggggagcaagacccctcagcctctccaagggtcacattgatgtaaatgaaggtgtcatccgctcttgtagggaacagtcacctctggctttaccttcatgcctttttgaattgtaaagggcaaaatgcctggagtctatcaagtctacacatagttattatactgcaaaatttgtctcaattgttttgtgataaatgtgtatttcccaatcccccacctccttccattataacccatatgaaccatctatggactagaacatagcaaaaaacctctctatggtaggagaaaatgtatttattacttatatgatgcaaacaatgtagaccttttcattttgagttggagagaggggacacacaaaaattgagaagccacattcccacaattctaggcagaatttgatctcacttttttacttcttttatttctctttctcccttttttcttattctttgtcctcatccacagagaaaagacaatccaatctggagtcctagggattgattattccacatttgtccctatcttctctttcccaagagaagatccctttgtttctgagtttacatcatgaaaggagtttacatcattactccccccttttttatttaaacttaaagtacatgagtaacaagaactcttacacctaggtaaagccttgggaagggagcaaactgctcaggctgctaaggtgtaagaggatgtatgtgaaggggagtgctctgagaggcaaccatttctagggaaaggtcttgtcctcttagtaacaacaacaaaagaagtccattttcaaacatctattagacaatgtcaatctttcttttcaattgtatgcttagcttagcaaagagagtcaggtggaatctcacaccttgcccaaattgtatttggtgtgaggctcttcaaagcttccaagacaccatccttctcctctccccctatcagtggaacagataaaactggagcaacctgcattattctaaaaccatagagatgatatttctgtttgcttttctactcattaggaagctctgagaggatgcataagaaatgaatcacagtgggtgaagaaactggacagacttcagtgggtgaggaaactggggagacttttcacatgtacattttgggtatttttaaaccatgagaattactgcctattcatgaaaaattaacctgagtagaatatatatgagagagttgctgctaaatatattccacataataccacatattgaggaggaggatgttacctactgaagatatgggattgaaaaacatgcaataactttctgttttgctcaatgggtcataagttgaaaattagactagaaaatatttgttcagagaagtacaaaatcttaggtgaggcaaaatgcacactagtcctctcctcccttatctttccaaatggggagacttgtcagtttaaagccatttgctcctccagttaagttctaggatcgtagacttggaggactggctgagccatcagtcccaagtggaaaggctaagctaagcatacaactgaaaagaaagattgacattgtctaatagatgtttgaaaattgacttcttttgttgttgttactaagaggacaagacctttccctagaaatggttgcctctcagagcactccccttcacatacatcctcttacaccttagcagcctgagcaattttctcccttcccaaggctttacctaggtgtaaaagttcttgttactcatgaactttaagtttaaataaaaaaggggggagtaatgatgtaaactcttttcatgttgtaaactcagaaacaaagggatcaactaagcagggtgtggaacaatcgaccccttctacccataggtcattaaatggctgctggatgccaaaaagattttaagctagaactgttttccttttcaagaaatatgcaaataaacaaacaaactctaccaaaggatagagctcttcaggtcattcttttgtttatgtctcctgcagcttttcctgttgcatagtcccagctaataaacaacttaagccactcttacagtgaagttcaaattgcaaaataagagacttaactgtcttgtttaaaggtatgctatatatcaagtcacaaggcaataatatctattctatccttttgcggcaataaacagacccgccccaaaacacaaaatcagatggccttttcccacaaaggcaggtggttaacaataggatttccaaagggcactcatttatgttggaagctgataggcatttcacatagtgaccaggagaaagaatgggtcaatgtttgtaatacccaaaaaggtggcaactgggggaaacggtggggcaggaaggaaatggaagggagttgaaagcatccttggtttccccagctgtttgcagaagttggaacatacggtgccaggatttttccaagatggcaagggatagaaagtaaaattattaccccctgccccccgccaaagaatgccttccaacaaataaagatgtattcgcagtttggagacttttctccttccacaggaaatgagcagaggtcacttagaaccaattctcatcatttagtaaaaataacagggtgataatagaagcaacagaaggagtcaaggtgtttgtgctaaaaaaaaaaaactttaagttcaggcctggcctggagtgggaatatccaaatgggttcttcatatttcaagttttatagacagtcttttccctaaaggatatactttcattaggtcataaatgcaccaacagatgagagagggaaagaggtgtgtgtgtgtgtctgtgtgtgtgtgtgtgtttgcatgtggccagaatggcagagcaggtatggaggtcaggctgtgcggggaggtggtggggctgtgtgtcacccacctgtgagggcagcagccagggactacgacttcaggtggccctctgtgcctaggcttctccttggttatcttagttctcaggtttcccgtgggttccactgaggctcctaattgctccaaatccaggcatttacttgcctaaaggccacaagaagtggggtggggacgtatctttttcagagagtttgttaaaaatttaactcagagaagtgtattagttggggcctcaatgcctgaacttgggtgggagaaaaatgggttgtttggcgactttcatttctcgctggaccccaattccccagattggagaggtttacctcctccaaaacccaaggggcccaactgggtgcccctcgggggccaatgctcttcatcttcccactccctgttccatgcaagagaggactttgcagacagaatcgtcctgacccgatagccacgtaggcttccttccgagcacttctcaaagtgagtctgggttttgctaccagtatcaattagccgcttctggcgaatcccagagaatgtttaattaactccacagctctgattcacacttacaggttggtagcagtttaaaattattgtaaaacaccacccggataatatatttactttttgtctaggccagattagcaagacacgcgcacacactctacgtttaagtcacaccctgcaatgcagagaaaatatttcaataggcatctgcaggcggccgagaagaactggagcaatgattattttcctccttttttgattttctgtttctaaagaaagcactggtatcaaggacgagttaggtaatgcgtattaaaaggcaagcaggtcgctctcgtttacgcccaatcatagttcatagttcaaggaaaactgcctttaattgacaccgtgtatattcctctgctcctctcaggctgccctggcagggacgccccaagagtatttatttctagggttggaaacaaaacaaccaaccccgtctactgcgtaagagagcgttccaagatggactgccggagaaaggctttttgacccctgtggaaattagtcatattgacagacgcccagggaaggtaaattaccccgcgcgctgacgttacgcagaggcgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaaccttttacaaggcatgtgggtacaagaaaaaaaatcaaaataaaccactttcatccagcatgggcagtgaaaagaaaagctgccttccagagggggcgagcgggagttttgaaattcattgtgtgttttgcctttatataaggagttttgcgttttttaccgataaccaaagggggacactagggggaagtaactgctattttttttttctggagagggctgaaataaggggttcaccggttctttcacaatcagatggtgtcccaggactgcaagtaactgcgtacatccacacagcgcattacaccaacctgagaagaatccttgcgtgaccggattgtttctggtataaaatagggcctaacggtcccatctcttttcttttaaaaaactgagtctgtggagggggcttattggaaagcatcaaaagagtggcatctgattttctgattttaccggagattggactggaggtcttctttactaagagtaacaggcgtagccacaaaagagcctggtctggtcgcaaagtaaaggcaaaactagtgtgggcccttagcctcgccggccccggccctcggaatgcaaaaggcgaaagctccctcctgggcagggccagagcgagagcgagtgaggagctcctcccggacctcgggcctagcttcggaggtatttttagctcctctctctgctccccagaggctcttttgtaagcttaacagaggctcagcaagctgccctcaccccgaagggctgtgggaggaggctgccctagtatcttgaagaaaaaagaaattgcctatccttaagtttaaaacaatattcgctctctctaggctccccttctgttctctcgtttttttcgcccgcaggaacactccaagttccacagttaaagaggaccgggagggcaggaatgggtggggcctggaaatcagctccgaaactgggtgcggcacaccttcctctgcctttctgcctctctcccggccactgctgctccacgggagccagtcttggatacctagggtgggggacagggggacgggaagagcctcggttgtctccaggtaggcagggaacccggagcatttatttaaagttacttatttttttaaaataaaggcttaaaataagtccaaatgtttctgcaacagagtttccaacacactgttcaggaatgcgaaactcgggacccagactagcaatccccaagtgggtgaattcttattatgtagaaacctgctctctatgctccccctctcaccttggagaggcctcagtacagccttcgggcttgggccgcaggcttccctggacttccgcagtcccccttctccccattccagaacctgccgagcccctgctgcatctgggacccgccttcaccgtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctattagcagccaggtagccctgcgggtcgaagatgctcagaggaggagtaaatgcagagaaaaaatagaggaaggaataaaaaaaaaaacaaaacaaaaacacgtaacatacacgcactcaaaaccaactttgggattggactttttcagtttcacacgaagagacttggagtatctggagaaggtttttgaagacgtttaggagggagggtgagttttctgctgagaaactcaatctgccatacagtagcggccccatctgggatctgtcactgctgacagcaccagagggcacagccgtgatcttctgcacagcctgcactccccgaaataccctccttaatcaaaggatgtctgcgcgcctgagctcagctgaccgcgccgggagcaccagggccgttggattccaccccagcccgccccctccccacgcacacagccacggcccctcgcgtcttcgcggcacgttaattaaatgcggaaaacagacagaggctgatgtcattgctctcacaagatcataaacgtaaaagagtcatcctgtgagaatccctgaaaatgactttaatgaataatttcagagacagttatgactttgggtgattactgagcaagaatatgaaaaccagatttgcaaagcgaaggcgatggtcaaaaggcctggcagttactttctctcattaaaaccgcaccggctttccttcttcgccaagtactagttaccaactgaggttgcgttttcaggttttcttcttcaaaataacagtcttcttttcctgcttttctgccttatcctaaagacaaaatgtcagctccagggaacgacattaacaacccactttaaattgaaggcaactctgcactggcgtcagtggccattggcttccatctttttacaaaggttggatttactgccatcttaggatcatatctcttttggcctcttctctaggcaatgtatttaatgaaggttgaacattctcactgaccctgagtcagtgcactgtttgttgtaaaggatctcagctggtggggcaaaaaacaagttccaaacaacctgcctttacagaagagtctccctgactctttagttctaggtcaccaatgaactgaaaaatgatttggtgctacattaaggaatattttcaaacactccatctggccatggagaagcatccagttggttatatctggttgctcatgcattaaaaatactatttgagaaaacaactagggtgttagttgtggaagtggcctggtgagtaccctctgatcttttgcacgaagtttagctgcctgcaagtctgtcttctttgcttgaaaatataaactgggactctctgggcctgtgtcccatgtggatttattccacttaattcaagtaaaagtttgtttatactctgagcaagaaagtattataggcacaagtgatgtggagttttcagtttgcttgttttttgctgttgtttgtttgcttttgagcgatctgagtgatttagaaaactaatgtgtctcagtcggctccaccattcagacagatcatagagaacccacttaccagcactctagaaaactgtactttgtgcagacattgcctgatcctcccctttctagaagcacagataggccagaatccttcagtcactgaggacacaattgtctaaaagcctcattccctatcattagcccccaaaccgcagagctgtttccttccctcttggctccagataggggtgggtgggagaggggactaggctctccatgtgacatttccctgacttgagaggaaatgtttctttctgattctagattacatgaagacactttggagttggtgtatagggtttcctcaaagaactgaggtaacgtggactttagggaattttcctcaattggattccctgtttatttgtgatactatttgtgtcccccaaatagatcttcttgttgctccactcacatcatgagcagttttccttttcctctagttacattcactctagcttctgactgaagactctgcttgccctttgtagcccgtgcaggaataaacagcatcttctggatttgctttgaatccttgtgctgcccaatgagtcagaggtgtagggttgatccaataatatggctaattctctccctgtaaagactttaaataatgtaggcctctcttcacccatcccccattctcaccatcctggacttcacgcgggtcatggagaaggtgtccagggtgggaggcacgctgggtgggtgtggcctcctttggcacagtggttcggcatcctctgggggagattttgaaaactgcaggctccgcgtcgagcccctgacctgctgaatcagaatttctggtgaaggtagggtgaaaacggggctgaatttgtcattgtatcaagttgtccggggagtggaaagtccaggtgttggattaatcccagcaccccttacttcagaagagaccaggctatcccgcagaacgctagggtcagaggtctggggcatcagtcagcccgtccaggaattatgcaaatatatgcagcctctactctgaacactgggacgtagtaggggacaaagctgccgccagccgtcctcgtccttgcgaggtgtcagtgtttgcgccagggacaactccctggagggctgggggaagggaggggcaaaagagggtccagggcctcagctcgctatgtactttagggtttaataacaggtgcaaaggcagctgctaaaagacatcgcattctgtaatcagcttctgccaggctgtccggctaaacagaaactcccacaattttggcccgagggctgtagggcggagcgggtgccagtgagatgagggcaaccctaagaggtggcataagagccttacccctaagagccaccccaaccccatccggggcttgcaccggcaccgcctgggccgcagttgttgcctcagggaagcttcgccctggcgcagggatagagcaaagaagcgaccgcatgtggaaggctttccaggcggaatgctccagccgtagcgagttggaaaatttagagtggggagggggcagtagagatgttaactggcccctcctcaccccaaacaaggaaaacacagtcttctgggctaaaaatacatatttatgaagtccctatacgcaggcaggcggcgcgttccagctgccggcctggcccagggaggacttggccgcgcggccgccgattacacccaactcggctgggatggctccgagccgtctgccctgacgtcagcgaggctccggccccgccgcggcaagataggcgagcgcggccgggcgcgggtgcggcactaatcactcccagatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtccggcccccggaaacgtgggattggtttcctctcccggagttctcccctcccccttctttctaaacatttaaaaaacacgtagtccgtctcccccaacccccattcccggtagacttaatcccaacagcaattcattgcaccgcggagcttcctcagggagggggctgttggagcctccaaccagggtcctgggccccagtctgagaatgactcctgggtttttctctccaagcgatccgcaggctctgacaggccaggagtcgcgcgcgtccgggagactccttagcgccccctcctcacgtggagatctggactctcaggagctgggcccaatggaaggaatgggtacccttgggtcaccagggtccagattcggccctctacggcgcccatgccacaagcctccctcaagaccatctctgcttggcacccactagccagctccttttccaaatctaggagcctgggtgggactcacaggcagggagaactcaaggcggctgtggaaaacaaaatcgcgtgccgcccgcgcaatatttgattaaagcttcagggctaactgagcggtttcttgcgctttgcaggcccgcagtgtatgttcagtcccagttttcctggcaccctttgccctgcttatgtcccctgcacacacctcaggcccttgcaactggcccgggttctctctgcaaatctgtagtctgggaaggaactcccgggtctcgtactccctgccgctttgcatttgagctctcaccttcctcaccccttcctgcgaattccaggtgcgcttacctctcttgttctcctgctacttcaccaatccgagcgggagactagctctgcaattcacgccaagctggggcagcggctagcagagtctggtcgaaggaattgaaccaccttccactcccgacacacgcacaagtgctaagaggcccccaggctgcgctccctggcacggctgctacgctcacctcatcacgaccaagcagcctggtgctcctacacctaaggaggcaacccagacccagaggtccacccttcctagatgcctgggcctgctggctaacccatcccgaaagctggagcttgctgtctcggcctggaaaagccctttaagttgctgtcagtgcccaggcaattgggagcggggcccccactctgcagtttttcaaattgcttcccaagctgagaaggggtttgcgcgcgcgcacacacacacacacacacacacacacacaccgtctacaactggccaagcctttgcccctccggtgctccagggttatcagacgctgggcctgcacagcggtctggggcagagccctgacagccagatctaccatcaatttaccttccgccgccgcagcttcccatttagcttttaacgtcaaatcctacatttttgtcggctccggcctgtctagaacgcttgtgatttccctgcaggagtgattgctcttaacaaaatggcagcaaccacattatccgagcaattaaaacagaggccttttagccggtcccgcaagtagaggcttggaaaatttttttaaacaaagaagaaaaagttaaaagagaaataagtgttggaagagaaaagcatggaagctcagaagaaacgtctgcccagtacgcctttcacttcctgggacttgacaacctggggcggggatgttgggtggctgagagcggctggggtgacagataatctggggtgtcctgcaggttgaagcatctggtcagttggggtgtgcgtctggttagggggttcagccgcctgcagtgtcaggcagctgggcattctgccgtctggggtgtccggtctgctgggtgtctggctggttagggtttctggcgagttgaaatggcagggcgggtggggtgaccaggcctagtgttgctggccctgaggaagaggaggcaggctgtgcttggccggggccaaagaggagcgcaggtttaaaaagcaagtgtattagcaagtttctccgtagcaatggtgcgccagggtcttttggtttccctctgttgttgtttaataagccagagaaagtgttaaatctgcagaagtgccttaaggcccagatggcggagaccagctacacaaggtgcagagaagcgtaggtgcatggtgaagataactcctctccgtttcctgtttttaaaacctcacctcctccgccactgtttactccaacactttggtaggctcctttcttccacgtctaggacctgatggctttctcctgagcagattaaaataaagacgcggaagacaactggaatcaggagagggagggaaccactggatcaaacgcaggaggattgggagagcaacagaaaatcagggcgcgcctcccccacacctcctccccatgctataaacaaaggcaagtgtctgtaaacacagccccgcgcccaccaggtcggcccagcgccggctgacccaaggggagaaagttcagatcgctttggccgagttgttctaacccctcgccctcgcgttgtcagccgcccgcagaagtccgcagagcctctagcttgtctctccctgggcacttctgaattcgcccacgccgggtctgattcggcctgctgcaggcagaggggtcatagtggacaccagctaggcgtgggaacccttgggacatcgcgggagggtctgtgcccgaggccaagttgcgaacatcaccctgaggatgggttccaggatggaaaccctctggcaagcctctccaacaccagatttatatacgcggcgttccatgaaacaaaccactttttaatacggttcacctttctcctcctcccacccccttccaaaatccctcccagcctcctccccccttcccgcagcctgcacaggcactttagtttctccggtttctagagctgagattcaagcttccgccaaggctgcaggcaaaggaggccgctgggactttcttctgggacgagctgggactcagggagcccaaagacccaacagggagagatcccgggtcccgtgctgccggtagtcccggaagggtgtcgcttgtttcgctgggctgcggccgggaagacttcagacaccgcacagttaatattgagttccctgtaactccttgtaaatctaacccgcccctcgcccctctttaaatccgtggtcttgttcacgatttcttacttgacgtaaaattccttgttacctaatcatggactttttcgaaactccctccacccccctttcccgcctgctcagatgagaagcccccgtatagaatacaagcaaaatcctctcctctcttttctttttccttttttttttcttggatgaaagccccatagtttgaattaaacaccccagactagttcccgttgcagcaataatgccggggttctcctcacaactcctccaccagaaacactctccaaacaaaaactgacggcctcaagaaatggcttctgattgacttcaggaaagcaagagcacctttacaccttctgagcgaactgccggactgggttctccagcccagatcttccttctagagactactcagcgttctccagctgggggaagagggaaggagacaccacaccgacaaaccccagaccatttgcaggatttgtaacaaggacacttctctttaagagcacctcctcctcctgcgtaggccgcaggtcagggtgactggttggaaccactgagtctttaaaataaagttagaggcaatcatgataatttagtttacttctgaatattttaaatattacgaaaacaagtataacagctttgttttcaaaactcttttgaggtatcagccattaaaagattaaggtttttgtaaaaaaaaaacacagtggtttattgaatacttacaacgtttacaccttcaatattaattaaattccatttagttttagaggacggaagtgcacaaaacaagtggctgttggaaacatcttcaaagagggaacgaccacagatgaatggatagcactagataccgaccccaacggaaatgttagcggccctgttttctgctttgaaataaaactttataatacccaggaatatttatatccaaaggccaagtattaaagatacacttcacaaacgcactagtgcccactgtctttatctggaaggggttgagtaggttggcggggggcaacgctggtgtctacacagccaagagggaacattcacgcacacagaatctatgagacgacgggatcccttaccacacgggagtgtcctcttcgtattaaaatatggaatgcttttcttcaaatatccactttttttttggagggggagacggggagcagatgcctcaaagggggtcaaagagaggggaaggaaattgcacataaataaaccggatgattccaaatgcaaggagtcctcagagcggagcgcggacggcttttccggagtcctgggtctgcatctggcgccttggcccctgctcactcgcgctctcctcctcctccttctcctcctcctcactgcttgagctccagggcccagacgtgctgcggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtcccagcccctgcagagaagctaccaaggttagcgctaccctagccggcggggaggcctcggcgctgcagcgctcaacaaccggatccacaagtttataaacaaccgcccgttttcgagtcgtttatggaggagcggggggccttttctcttactccagatgtaggggcgggagctggagtcggcgctaagtctggtttctctgttttcattagcaatcctagatccacatctaggaaaaatagggcgaaggagcctctgtttcggcctgggcctctcggccagaggctctcggcctccagctcagcagtgcctctcctccaaggcttctgaaatctctggttattcgggaggtcactcgattatgcagccaccaaagggctgcaggggccaaagaagaaaaattcgacaaatgcaattattttccgggcccttcgtggacatagctctatcctgcaccactgccctgtgggcacttggtaggaatctgagaaaattttaagcggctcaatttactttcgtgttatttttaataacaatgaccatagtaatgccttttcccccttaaaatgtacaggcttattcaaataaaattagaaatgccaatggaatatactcatctgggaaattacattttaacgtcatagccaaggaaaaattggagctgtattttgaagtcaaaagtacttattttatgtttaccattacgttttccgggcatagtatgagaacaaccacaaaactcagggctcagtctctggcagcctccttctgggagtggggtagggggtgcgatcaatagtgaaataattggaatcaagggcttcttcgagacttattctggaaacatctgaaagcaagattggattggaggccaaaagaagggtctaacagagacggggtgaggcatccagaccagtgcgatcgcgatcgatcgcgacccagagttttcaaggtccgtcctaagtactaggggagcagcgataacccggaggtaagatcaccagcgcaaagcatccctaaccttctcctcctcctgctgacaccctcccctcaactctctgcttatgccggaagccatccttacacaacctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccaccgggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttggtaagtaactgaatattttttacggcgtgttcagagcttattttccagtttttatgaacaaacatataaatatatctctgcattcctgcctccctcataaaagcgggcatctgtggaaagcaggtttagttatcggaggggaaccattaaacgccagtttaagaggcaggccgggaggacggctcgtggatgttgagactgctggccttggtgatcttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccaggttagcccaagggagaccaaagactccaccttgagcatcgccctttggaggcgggcagagtccggccgcaggccacaaagcgatccccacccgaaggactccacaaggacagtcctttccttgctcaccgccgacaaagtggttggggcaggaaggcgaggtcagtgcgaatggagggcgcccaacttcggtgttgcagttgactctgtgctcgggctctgccctccactagccctagagtcttgggcagcaggattgagaaatatatatatttcaggtttgccgcggctgggcggtaggagacagggacttaaaagcccaggattagagtcggtgcagggcccattctttttctaggaaaggggttaacatccttgaacgtccccagacaagcgtcttaaagcattgaacctagaatagggattaactgaaactaggctcgttggtaagcgccaggggcttgcagttgagctcggaacaaaatagtgacctactgctctaaacccccaacttgcgtgggtctgcaattttttagcacaaggagagccttttaaagacctggttcttcaaggaaagaatgcaggtagtgtggttgggggttctgtttacattttcacccggaggcaaaccccgaatgtgtaaatactggtagttcaattctctgacatttgatacgtttttgaaaagtctgtttataaaaacacatttaggccttgggagcaggtagacaaagtaagattgcactggggctgggaacatataaaaattcagggaaattagttggttggctgctttaagacccaaagggagttttgggaattgaagggaggaagaagagtccagaggagggctgagttagggattgagatgctctgtccaccagagaccagcggtgagtggcctcacttttgaaagcttcagaacttgccacatttagcttttctcatgcttttaattgaaacaaacaaacaaacaaaaatgaatgaattacctcgtggctccagatagcattgcaagtggtaaaggaaatggacaacatggtacagaaaaaagaaatcataaaagatgctaatctgaacatcagttctcactcacagtgtcattatcagttaactgctgtggtccaagggcctaagacttgatgtggctcagaaacccaaatccagaggtcactgccttagaaagctggcttgatgagaggggacaaatggatgaaccctagtggtgtccccaactgtagtaactgactcagggaggccaggctggccctgactggttgagctctaccctaaatgcacaaacgcatccacttttctcttgcagtgtcctttggcctgttttgttccaggttttccaggatactgggttagcctgctcctttgggaagttgtgaagcaaggatgccatctcaagtttgccctcaatttaggtgtcctgggcatcctggtggtagtgatggaggtgttggcagtggtggcaatgaaggagagggtggtgttggtgatgagagggaaagtgggagaagaaagggagaaaggcacagtccctgacatcgatgtcagcatggggaccccactcctgggctgcactagtgtagctgctgatgcacatgttgtaagtactcaaaggcccagggaactggcttgctgggggctcctctgggtgcctgtggaggaatcttagctaggagtgcttctctgcctctcctcagaggctgagggctgagccaaaaccggccttactcgtgtccagaaactgcttcacaaggaggcagcccaggtttgggtgagtgtttgggattctgtacctttgttgtagctgatggtgtacctactgtactgcacatgtcaactgccttcagccaaatagacagaatctggttcaagcatttattttgctcctcatgtctcttgtctctttgccgtcactgctacttctttctctggaaaaagacggaaagagcagcagagaggctgaacatggccatgcaaacattttggtcttgtgagatattattatacttgaaaaaatcaatctggtttaaactaattttaaaaaaatctttagttaggttttagggaaaatacagattgtctcagggtgtttattatttcaaaggcaagggcagtttatatcctctgttttgctcataagaacccaaaataaactggacccaaaaagaatcaggccagagggtcataaatgcacattttatgttcatgggaattatggctcaattctcatcatcgtctttcaaatcttgtttcaccttgtttttctaaccaacatagtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccagggtagggtggagtcattttacatgctatccacttagtcccaggatgtttaggatgctcagaacaaggcatattgtctgagtggtggcaagggtctccctctaactggggttgtgtagtccttcctgtttgtgtagttcttcttgtatagtcttttcttgttggcctttgagaagtagttgtctacagacataccaagtgaaagtggctccagaagtgtcgtgctgctcaaagtacacatctgcaaagcagaatcaaattttgttggatttgagtgtctatttcaaaaaaggaagaataagaaaagctgcccttgtgtcttgtgaggtttttttttttcttcttcttcttttaagcaagttttttcctcttcttttaagcaagtttttggttaagggggtggcatatttaggggttggatcctcttcctttctcttccctacatggagagatggagggggaggggctagttcagctgaatgatgacagtggaggggctgattgcttatgaatccttcagtccagctctaattagaaaacagttaagttggtggagaaaatcagggcttgcttagtgcctgcacattccctcctcctctttctcctctccctctttcccttctttcttccttccacccccctccctccctctctctcttcttctctccagttctcccttgtaatttgccgtctagcagcatttgggattacaaggttttttttcttttcttttctttttttccctatcactgaatctgcaactggcatggaagaatgagatactgattcatgctgaagtcttttaagaaaaatcttaatatccacagtcagtagaattttcctttctttctaaataatcaatgactagatcctcatgttaactggtagatatgttgctgcactggagggttttcattgataaggaagaactaaatatttttccaggtgtctaagtgtgtctgtaaatctaaaatcctcattcagactaaagggaccataagataaccccgtgaaggcctcaaagaagcagcatgatgtagatacatgggacgtattattaacgttattatactagtcctaagaggtacagtaaatctgatctttgttaatctttgctactttgtagtaaaatatagagtttagagcaaaaccggtctgagaacctacatcccataggatttatgttaaatactcattcaaattattgcttcaagcaaattacatacacactagcgacattttctttcaagccgggaggaaatcactcaacattcagatgaggaagtgtgatttttcatacgtgttctacggaaatagtaaataatggacttcacctagtctgcagtgtattatggggttcagaataaaatatgagttcaactggcaatttcaaatgcggctttggagagaaaacatttatttgactgaaagatttgcttctgacttgaggcccaggaacattcccagttttaactgtagtgttgcattcctgggaagttctgttccatagcttcctttgcaaattcatgtagatggatttctttagctctgacagtttcctccaaacctttcctacattcttccagggcctttgcttatagacaggggagttacaccaggatggttaggtttcaggttaacaaaaagaaacacttttattgtcaatattaatggcaaacctcgatttttacaaggcttgggtttagcagtgtgagcagatcaaaagcagcttggtttgatttctcaatattctctggagcttagacaattaactgcaattttgctcctaacaaaacaacacaaaaaagttagttacagaaatgttataggtaatcttttggcagagatttttacctgagtacaacatatcagaatctagaaaatttatctactgaacttgagttgagttttgcaggaaaaccccttaagaaaatcttgtgtgaactacgtcctcggttgcaatgccatgagcctgtttcagtgtgtgcattccaggcttgcctttctagctgggtaaggatccggcagactgaggtctccttggtaatttgggtacaccaagtctccagttaatgatagataatcagcctttgggtcattcggtcattctcttattacaaacccctcctgctctctctgatctcctttcaaactaaatttcacacaaacaaataaagcaagacagggacaagttcttaaaaaaagagagagaaatattagaaacgcctgatacagaactctaaacaaggaaaggcaagctaaaagaggataggaaagaacatcttatcaaaatgaacatgttgtgtacaaaacattaaaagaaaaggctctggtttttgttaaagtgacagaaaattaaaataaaaataattgcaggcaccaaagttataaacagggaaggcaggatgctagctggaaatgcgcagcactagggagctaatttgttgttacagattatatatctgcaccctgcttggagaagtgctactttgttccattttccagaagagaatggtttttcttcttaatacttgtgtgaatgcccacttaagttaacacaggccacaactttgaggaatgagaaatggaattgcattctgcttgcgaagcatccaacttcaaacgaagaaattggttgtgtacaaaaaaaaaagtagaatttcattcagaatacgtttggagacttcactaaattggtgtgactgatgcttttttgttttgctgacagaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttcttctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaacgtaagttaaagggggaatgaaaagtcatctattacctacacttgaagtgcttattgcggatagttcttaaaactttttgtttttctgattttataaacgtaatatgtgcttattgtattcatctgggaaaataaagaaaagataggccgggcgcggtggctcgcctgtaatcccagcactttgggaggccaaggcaggcggatcacgaggtcaggagattgagaccatcctggctaacatggtgaaactccgtttctactaaaaatacagaaacaattagccaggcgtggtgtcaggtgcctgcagtcccagctcctcaggaggctgggggaggagaattgcttgaacctgggaggcagatgttgcagtgagccgagatcacgctactgcactccagcctggacgacagagcgagacttcgtctcagaaaacaaaaacaacaaaaaaaaaacagctaaaaatcattcttaatctcactcagatataactattattaatttttcccttctttgcaaatacccacttttaaatgtttagatagttaatattttatagagtgttgaaagaaaaatttacacttaatctcaattgagttttgtatggagaagtttttgagggaagaacttttgctagggaagcctatgcaagatggggaagccatgtggtgtcttctgtctctgtaggtctttaaggatgatagtaaattatgtcttgtaatcagttgttaatgaattcttaaagttttctttgttggcgtgctttggtaagggagtaaaataatctagttcggtaccttattcaatgactagctgttggtttgaaccacccatcaatcttcttcaaatgcttcatgtacccacccttgagtcaccaggggctgccaattcagaaaacacgggtgtcatcagttggcagggaccagaaatctcctattgtctcctccttttcttagagagattcaatttggtctaaggggcttctggagcagactttgagggccttctcttttcaatggaaccaagtcacataatcatgttgtctgtattatatggacttttctcatgccatgtaaatggctaaaaataacttcacatattgttttgttccatccccacaaggactctctggtttggcagtttggtaattttttagtgtttatttctgctgcacataggctattcaaaatattgctaaaaatgtttgatccgacttgagtaatctaaaatgataatcttgaactttataaatcagtttttcatcctcagaggaattttttttagatgttgtttcctgcactattattacttcctttgatctcatattacatttggtctttcagataagggagaccaataattccttagctataacttcagcagcccagataactatcatacattgtgtgacatgcaattcattattcagttgcgaataaccactgcggtccagtcctatattaaatgttttacaactcgtgtcttcctagctcatggagttaatataatgcttgtgactatttttctttccaggcaggataaaactctttatattgcttaatgacaagtaatattaaatttaaaacatgttaagacaccttagtagaagaaactaactacagtgaagtaaatttccgtatgtagcttaattattttattttattctctcctttaaaggggcctcctctctttgatgtatccagtaattcttattattgccttttgggtaaactggatgaatttccagaagcaagattcagtttcagagatctcatgatccgcatttactgatgttccatcattcctcctttatcccttttataatgtaccattgtcttatttgcctggcataaagacttctttggaatgtagtagaagacaaaagattggttcaagatctaatcacatacttaaggacaatcttcctacagttttcagttcaccaaataaagggttagcagtctggagatggctggaagagcagtttcctaattttgagtctttggcaagctgaaattccacctgctaaaatttaacagtgtagagattgttatccagtgggtatttttgcaactttctgtttggtgctcaataaagcagactgtattactgtgctggaaaaatgtaacttgctactcattggagtattaatctatcaaaatatttcctggacttattttacaaattaacaaaagagctattatacatttacggtcagaaagttcttagttcatattgatatttttaattccttaattgaatggttttactttctagcttaatgtagacattattttcagattattagtgaactaagaaaaggttaatttgtaagttgaattggatttttgttacaaactgaaaagcctttttttttgtagcccaagaacatttgtttccctggactctgtttctcctaccaacacttccctgggacctcattgccctcaaaggagactgccctgttcctttacttctacttctgatcagtcaagcagctactctgtcccatcagctcccattttaggaccaactgattctcaaacattttagtaaggatgcaaatgtttaatatgattgcaaaagagaaaaaaatgactacagtgtaacattttctggtatagacatcagaataaaagtctggtcacttacgacatacatttaaactccagtttaaaaagatttttcttttttttctgaaaaatcagttgagatgataatacacagtaggttattttctaatgtccatatctaacataaaaatccagattaggccgggcgtggtggctcacgcctgtaatcccagcactttgggaggctgaggcaggcgggtcatgaggtcaggagttcgagaccagcccggccaacatggtgaaaccccgtctctactaaaaatacaaaaaattagctgggcgtggtgatgggcacctgtaatcccagctacttgggaggctgaggcaggagaatcatgtgaaccctggagggggatgttgcagtgagccgataatgcgccactgcattccagcctgggtgacagagtgagactttgtctcgaaaaaaaaaaaaaaaaagacccagatcaaatgatttttttaaaaatttgttttttgcccaatcatttctgggaggtgtatgtagttgttgttgttttcactttttttgtggaaaatttttagtagtgggggttcaaagtttgtttaaatatggaagataattttccaaaaataaagtatggactaattaaccttaaagacacaaaagaagagttgctttgaattctgctatcgctccttattcttgcttaaatccaatttgttggtgtgcgtgtgtgtgtgtgtatgtttgtgtaggatttgtgtgtatggatgaatatggaaaacaagagactttaatggcagaaatgaccacagtgaataagatcaaattatcaggtaagttgaggctgtacagaattacatgatggttgatcttgataccaattcaacaataatttaaaaaatgatgataaatctttacttggtctatgtagcttcaacttaagtgtgtaggccctggacactactgacgtaagcaacctaaactcacctaggcaacgttttgtaagaataaaatctatagttaataatgaccttttcattagcctcttctttgtaactgcccatgtggactgtttgctttgctgaactgtcaaaatgctgacatgaaaaaaacaggagttatagaatcaaagacctcagttcagagttttatttctaggggactttggaaaagtcatgcagcttttctgagacacaatcatttcttctataaaaggagtgaataatatcacctacctcacaaggctgttgtgaaggaaaaaaattcattatgtgaagtgcccactaatgcctggcacctagtaggcattaagggcattttttttgtttgcagaatatgaaagatagtgattattggttaaacatttttttgtagtgtggcttttattttattttatttattttgagacagagtagcttatctctgttgcccaggctggagtgcagtggtgtgatctcagctcactgcaacctccacctcctgggctcaaccaattctcgagtctcagcctcctgagtagctgggattacaggagcccaccaccacaccctactaatgtttgtatttttagtacagacagggttttgccatgttgaccaggctggtctcgaactcttggcctcaagtgatccacctgccttggcttcccaaagtgctgggattacaggcatgagccaccgcacccagccggcatcaatcttaccatatttttgcattaatctcattaattgtcaatatggccccacaacatgtatttatgtgattgtttattagtgtcatctgatcaaactgaaatgaggaaaagaagaatagagagcacacttaaaaaaaggcttactgaaagccaggtgtggtggctcacacctgtaatcccagaactttgggaggctgaggtgggtggatcatgaggtcaggagtttgagaccagcctgaccaacatggtgaaaccctgtctgtactaaaaatacaaaaattagcccggtatggcacctgtaatcccagctattcaggaggctgaggcaggagaatcgcttgaacccaggaggcagagactgcagtgagctgagatcgtgccattgcacaacagcctgggcgacagagcaagacagcctcaaaaaaaaaaaaaaaaaaaagccttcctggagaggggcctggctatcctgagtgttttctttctggagatctaaatgcatttctgattccttactatgcaggggctattttctcaaatatttttattgtggactctctgggagcctcctcacaccacccacacactcacaccccccagcacatcatacagttcatttcctttctaacgttacagtaaatctcaaaggcctggacggtggagaaggctggaggggagaagcagctgcttctctttgctcccgtgggctgccattcccctcagagctcaagacgctcacagtaaggtctccatgacctgctgtgacatcccttgtgccctctttgtggttggaaaggctctaccttctattcggaaatcacttatatgatatgcccaaaactccaaagaggaaagggctatgtcaacgatagacacagttctcatttggaggttgttcaacatctcaaaaggcactcccctgccatttggggtgtcctaatgaaggctgagacctcaaatgctgcagccccttgaactacatcaccctatttctgtccatggtgggcagtactttaagggatgaagctctggggcctttagatctttttgcctcttccttctctgcaagtcactccatttacataattatgaagaggctggtgcttgaaatctgggaatccttgccaagtggtgtgacctttagtcttatctttattatttattttattttttcagagataggtcttgctacatcacccaggctggaagtggcacgatcatggctcactgcagcctccatgtcttgggctcatgagattttcccacctcagcctgctgagactacaggcacacaccatcatgcctggataatttgtttctacttttattttttgtcaatacaggagtctcgctatgtagcccagagtggtttcaaactcctggacacaagcaatcctcctgccttgacctcccaaagtgctgggattacagatacaagccaccacacctggccatctttattgtttaaagtaggcataataatacctacctcacatagctctgtgagccttagtgcaataagaggctgtgtgtattgcacttggcacattgtatgtgctcacatttttattgctaataataacaaaataaccaataaaaacaaaaaataataagattgacctcagaaacatgtaccttttcctagttgagcaaagacaaatgatgatgatggagacatgagatgtctttcccctccctggttctgctggcgtctgccattggcacattggtggaagaattgggttgcctggtcctatacctgttccatggcttaagccactgctggttctgacaattgcagggagccctggctgggggaaggtggctgagagtggcagcaatttcttcgttggttctcaatgagccataactctttcagattcactgctcacacatggcctgcatgcagatctggcagtttccattcatgatgcaggctgggaaggtagagtctggaaaactcataaaagcagactgagtggtaaaggaaaatcaatcttcttctgctttggaccaagttgacgagaatcattctccctgattctccataaattggagcaaggcttaggacactaatcctactgtaataccatttgaagatgaacactgacatttgtgacatttaaataacagttcaggtctgctattaaaccaaggcctccaactgtttaacctttgcccttgtgtactattacccttggcccagtgcatgcaaatgtacttattaatgcatttgagctttctgatgccacatgtttatttagttttgctgaataccttgcttcatgggaactgcactgcaccaaacacgaaatttgttttaaaacttttaaatgtgacacattccaagcctctctcagagattatttttacacagcttaagttaaataaaaagttgaggcaattatccaaaatcttcccgtgggtggaggagtgtgtatttcttgaactaaaattatttagagaaatccaaagccattcattcattcaacaaaagtttgtaagggctttttatgtatcacatactatgctagatcagaaatacggaaaacgtactccctgcccttaaaatactgtagctgtgtgattctatggccctactaacgtaggcatgtaccttaatttatacatgtcttactttagtctttgcctaatggcacatacaaaatctttactggtttcaaaaaagcagatgctcgttttagttaaagttatattaactaatgaattagagactgggggagatcttttccactcagacataattaaaaatattttagtgttgctattaaagtcaggaataacctttttcatctcttggatatttttctaaacagaagaaaacactttattatattcatcatcatataccatttcacgagcattgatgaatctgctccatgtctgacagataattaagttgtgtcattttactatgaaggtcacttcaagatctgagattctagttgggcttatattaagttaagtgcaggttgagttggcactgatagatctaagtttgatgactgcttctgccagtttctagacgtgtaaaattcagcgagttgcttaacttctgtaaacctcagttccctcatccataagatgggttaatagtaggtaccttgctgagttgctaggaagatgagagaaaatacttctgggaagatagttaacgtagagcctggtgcacagttattgctgttctggtccccatgctttagagagctcccttctccaccccttccccccaaccccagccctcccgcagctctgccccttctcacagcacaagcttttcttttataggtcagtggttctaagtttgcagtgatccttccaccacctaggagacatttggcaatgtcaggagactgttttgatttatatatatatatatatatatatatattttttttttttttttttttttctgagatggagtcacactgtgttgcccaggctggaatgcagtggcatgatcttggctcactgcaacctctgcctcctgggttcaaacgattctcctgcatcagcctcctgagtagctgggactacaggcatgcaccaccacacctggctaatgtttttttgtatttttagtagagatggggtttcaccatgttggccaggctagtctcaaactcctggcctcaagtgatccgcccacctcagcctcccaaaatccttggattacaggcatgagccaccatgcccagcattgatttttataattttggatggtgctatagcatctagtatgtagaggccagcgatgctgctaaacattctacaatgcacaggaaaagctctttctttcctctcaacaggaaagacttattcagtgtaaaatgcaaatagtccagagattgaaaaaccctgctctagaccatgctttgggtcccagcaactctgaaattctcccccatttagtccatttccagggtctctgcctctcatcacctgggcccaccggatggctatttgagagggccgtggacaaagcttggaggtgttggacaggtgcccacatacttgtgggaggcccctttcaaatgccaggggtggtggtgaaggggaatggctcttggtccagccctctcatgccaccatgttccaacgtggagctccgaggagtctgataattctaaattggaacctggccttccaggttgttatgaaggtatgcttgtcaaggtcagaggctaaaacattttatttaacatgttagtaagctagatttaaaatgtaatttttaattttaatttaattaattaattttttttttgaaacagagtctcgctctgtcacccaggctggagtgcggtggtgcgatcttgcctcactgcaagctccgcctcccaggttcaagtgattttcctgcctcagccttctgagtggctgggactacaggcggccgccaccatgcctggctaatttttgtatttttagtagagatgtggtttcactatgttggccaggctggtcttgaactcctgacctcaggtgatctacctgcctcggcctcccaaaatgctgagattacaggcgtgagccatggcgcccagcctagaattttaaatatttaaatattgagcatgtaggcctttgtttgcattcttgctctggatcccccaagagctaggcatgggcctgccagttagaattttaaaactctgcatccttccctctccatggctggggttacctcatttccatctctcaggctcagtcctaagagctcacctttactcgaggcagatgatgcgcgggtagctctgttgtcacatgtccacatgctgaggctcagcactgttttgttttggctgctgatttgttccagtttctgatcttttttgtagttgaaacatttagattgaggatcttcacaatgattactttttctgaagactttatcttcagctcaggcttgggactctggcagacatgttagtatcatctgatccaagcaggggccttcagaatctcttccaggcaattttgaactgacgtgcagaatcagtgtctgcgagtggctatagctcagtgctgtaaacatgagaattgctgttggacacccatctttcaccacaggaaaaggtggtgtggagagaaagggagagagagtcaggtgcagtggctcacgcctctaatctcagcactctaggaggctgagatgggaggattgcttgagcccatgaatttgagatcagcctgggcaacatggtgagaccctgtctctgcaaaaacaacgtaaaaattagctgggcatggtggcacatgcctgtagtaccagctacttgtgaagctgaggtgggaggatcgcttaagcccaggaggtcaaggctgcagtgagccacgatcatgctactacactcaagcctgggcaacagagcaagaccctgttctcaaaaaaaaaaaaaaaaaaaagcagggtgtggtggggcgggtaggtggaggagaatagggagagagagattgagagaacccgcctgggttcttttatttttatttttggaggtggagtcttgctgtgttgcccaggctggagtgcagtggtgtgatctcggctcactacaatcttcgcctcccgggttcaagcgattctcctgcctcagccttctgagtagctgggattacaggtgtgcaccaccacacctggctaatttttatattttcagtagagacgggatttcagtatgttgatcaggccagtctcaaactcctgacttcgtgatctgcctgcctcgacctcccaaagtgctgagattacaggcgtgacccacggcgcccagccactgcctgggttcttgatggcttttcaggtttgggaaagatctctgggttctactagacacctcagttccttccaaaaagatctcttgtttgcttaaactgaattgagttggtttctgttgcatgtaaccataaagaccttgacaaagagcccattttccaagcccctcttttggtaagttgccttgatctcggtgccctccttgagtggaggcctgggattgctcttgccagggcactggtgggcaaggcagtgcatagagcctactgctggatgccatactctgtctgccagcaggacccccttcccatcagtttagtagaggcttgactcctaggagctaatgtcagtgggtaggtttggttctagacctcatcccctcctacttgcaagaaacaggactattcaggccacgtccttcaatatgatgtattctattctgtatagatttgcaatttaaagatatgtctatgtatttcctaataaccagttaaaacgcccccaataaatggataattgcatttgtaaaatttatgaataataaaaagcaatttaacctggatatgtgcagtttattagagcaatcttgaatacatatcattgcagaaaatccagtaggagaattaagatgctggtacaaggccaagcttagaggatataaatggagttgtattatttccaattttactgataggaaaactgaagcttctggtaataataaaggtggagcttgaattgaggtctctttgtttccaaaggtatgaaggtaatagtaaggaacccaaaattgggaaatatagaaacaagtgatttcctgtggaaaaaggaatgttgggaatgacttttctttaaaaaaaaatctgtttgtgtagtgaaaaaataggttctagaaaatcacttagaaagtttatgtcacgagaacagaaaatcaaacatcgcatgttctccctcataagtgggaggtgaacaatgagaacacatggacacagggaggggaacatcacacactggggcctgtcggggggtggggggctaggggagggagagcactaggacaaatacctaatgtccaggttgataggtgcagcaaaccatcatggcacgtgtatatctatgtaacaaacctgcatgttctgcacacgaaccccagaacttaaagtataataaaaaaaaaagaaattttgttatgttacttaacaactgtggcctgcaggctcatctgagagacttctttctttttttctctctctttgcttacttgaggatttaagccagcatccacaagagtctgtggattcactaatacagccacattgttgttaaggacaaaaattctggcctttaagtctagtgtagttaagacaatgaactgactgggttgctcgttctccctctgcccttgctgataatgttttagttcccttcctctggtttgtccatcttttccctctcatctgtctccagtctattcactcagtgtctaccagcttatttggatgggtttgtctgaagttttctccagctaatacaatcatctatgctaatgttactgttaagatgccttaaaaaagtaaacaaattccaaaaatcaattccttaacctcctaaatattctattttagtgtttccaggcttagcatggccaaaatcttaaattcaaacactgaatctaattacagatctacatacaagaaagatgtttagagtcagtttgtcatgatgaggagaattctatgccaacagttttatgatttaattttgtttattcctaaaattcccagtctaatgggcctatccaggatcatgtcaaacatggaaatcttaccatggtgtggagtaattagattttttcccccaaattactttaccatacgttttaatcaataactagcaacatttaaactcttacaatcctatcagctgtaagagaaaagtaaaggactaattaaaagacctgtgtccacagtagaaaaaaaatgatgaatcttttcatcactcagcagcttagggatggtccaaatatattgttttctttttcccccttggagttatttattggtcagggggagggtggacagaactgcttttgaagttaaacatcttgcttggatgagcagatatgttgcatcaaatcaaagtaataaaaagacaaaatgctttattaaatcttctttatcactatattgtgctccaataggatgatctaattaaagacacagttgagcctcttttcatctgaagaggagttcacaggctttcattattaaaaggtttgcacagaaacaaatacgtggctgtattgcttccaagtttctcagcggtgcctcctttctgttttgctgtaattgttatggaagtcttggctgccacttcatggcttgatactaactagtccttttcatcttcaaagtacctgtgaggcattaacatgactaatatttataatgccactctgaggtaggcactagacgtctggaagtgttgtattctttttgaagatatgaaaacaaaagaattgaaagtggtgtctacttgaatgctgatgatgaacatttggctttctagttctgagtttgcagatgtctaagctggcactttgtcttcctaagatattgctaattcattctgcataacaggggactccttcaaactcatcaccataatccccatcatcaaaaaaatgtagaaaaattagagagaaacggactagtgattgcccctgggttgtgatattcctaggtcctctcaatttaataagcattcactaggtgttaaattgtgttttactttttttttttttttgagactaagtcttgctctgtcacccaggctggagggcagtggcgtgatcttggctcactgcaacctctgcttcctggttcaaatgattcttgtgcctcagcctcccgaatagctaggaccacaggtgtgcaacaccatgcccagctaatttttgtacttttagtagagatggggttttgccatgttggccaggctagtctcaaactcctgacctcagatgatccatccaccttagcctcccaaagtgctgggattacaggcatgagccactgcacacagcctttgttttattttaattcctgaataatattagtcttgcataaaatgtcactcagattctgctaccttaggggtcaaaagtagctgctgcatataggtcttaattgaccagccaaagtgttttataatttttttaaaaatttgcaattcttgtgatgaagtttgtgctccttagtttaccataggccttctattgttttacacagaattgattctgtgtaatagatgttacctgtatcactactggaagcatttgagtgtacttacttaaatagagaagggaaggattatcttattttctccaaaccaggacaaattcggtaagtcagcaaaattgatgaattgttgaatttccttgacatcatctcactcctgcccaaaatgatctcttcccttttccctttgtctgtcaaatttttattctttcttttccctttctccatcaaattcttattctttttattgcagttagcattctcagaggagagtaatctaataagggaatccacactgagttgtaaatgactgcaccagcttgacgttttacccctccagagctactggaaggaggatggtaaccatggcttcacctcttacatctgccaagccagtggaaatatttatagggacataactttttttttgcatgattgtaatctcgcaaatccaattatatatttgtgattattggcttttacactgtgtatatgtaaggcaagccttaccctaaagcctatttctataaggtacattcagatttctacatcagaatctagaaaattggaagaaatcaacaggaaaatgtttaaaaaggtaagtctaaaacattgtttatttatttaggcttctctccttgtgtatgaaaacatataagaagacaccacaagggaagggaatgttttgggacagaaagcaaagaaaagctagacagaccctcttccattcttacttccattctgaattggatgctgaccagcttggccctgggagtttcagatgcagatagggtggagatttccagctatgatgaatgatgaatgatctcagatggaggagctggtcagggaacagcaactatgcataagaaacgtgaaaccttccagtcgtgacctatttcagaacagaactgcaggcttgagagcggacagtgcagcgcagagctgcagcctccctgtatcttctcagccatgatcttggcagcttctttgtctcctgcctttaacttcccctcagtggagttaagtcaacctaagtcctcaaggactcaggcagtctaaaagcaagtcacttcctgggacatgagcatctcagttaattcctttagacttccatttaaaatttttacaggtttttagctttcatttaacaataatttgtgatcaagattaaattagagtttattttacttttagtgacattttcacaactagtttgaacttaggtctcttgctggagaaatatttacaaagaattaacatcagattgcatggtataaatgccatgccattcaactatgtaaatagcagctgagatgtttaattgaaaataaaacactggtaaaatgtaaacatcatttttgttccagttgcaatgatgtaggcttcatggtacaaatgaaagcagtaactgatggcagaagttagagtttgtaacagggtccaataactctcgtgtgtctggaaacccttttagtaactgctgtactcttgaatgctgttcagtccacttctcaaaacacactcatttcttgtcacaaagattggctgtttgaaacctcctacactggcactttaatatacaatccaatgcaccatcaggcattgggttcctgcgctcattaagctatttcctgggtgtaaattagatgtctctctaaattactttattctttcaggccactaaaagtacacgtgacaccctatggcatcaaattatgcttatttatttatgtatctgtaacattgtgttgtatggcgcaacctctgcaaaaccctcaggtcatatcttgacaagtataatatgggagtattaactgcaactaggttgtggtataaggaatgtataattactttggggacagttttctaaatatatcttttcttggaaaggggtcctttattccagatttatgggctgtaatatgtgggatgaaattgtaatacctttagatccaaactttggtgcaggtggaagattgtttcaatgatcccaatgattacataatttgtctttaaattacattaataaagagcttccattacctttcttgaaaaactcttagccacaaaacaataacttgctatgaataacatagatctaaaaccagacttcttacatcagctatgaaatctttgacaagttacttaactattctactgtttggctttctcatcaatgaaatggatatggaaacaatgtctagttcattgggctgttgtaaattaaatgaagtaacatatgtaaagtgatgagaacagtgcttggcatggttaatgttatgtatatgtgaatattattcatttaattagttaatatttattaaggatttaatgttttatcatctactaagatgcatcatctttctatattattattattatcttttatgggaaacaattctgtaaggaagtaaacctgattacaagctctcactgtttatttcccctaagtgaagaattagaatctcatgaaaatgtgctcagatgtagcaatatttttagtataaaccctttaaaaaaatgtaaagggaagtatctggactttagtaagcacatatgcaatgaaatattagtttgacctttttgaggtggaaatgaatatttattggaataataatatttcaaaatatattattgtgtttaaaaatagattataacacagcaggcacagaatagttccactttttaataaaaacgtaatgcctatggatgcataaataatcagcattttgacctttaaaaagttgattttattttattcagatggtaaagatatcaccaagagtataattctatgtcaaattgcatttttgtcctcatttagtgaaatgtttatatgcaaataatacttttacattttatgtgttatacaaagaaaatgaaactataagtttacggggatcacctaaggtaaaaaatgaaaaagatcaaacgttggaattcaatttaaaatactatattcttttttgttgagaaatggtcaaatcttgttttctggcatgagggtcaaagatcccaggatagattattctggtccctgttatagccacatctctctctatgattggagttaagtaaaacccaggaattattttatgaccttccttattgcagcaaagacattggtgtgaggcagatctactttgttttccatccaaggcatttcatttctgaagctcaaagtggactttgtcagaaatagaaaattatttccccaattcaaaggcttttttaaaacaacaaataaaactagcacatttataggccagatcctccctctcccttccctgggatgtccatgttatttagatttggagcaccagccactgtctttcggactttgaatcttgaggaaggaataagagcgtagtggatggatggagggctcgctgttgcagtggaattgggccggccagcatagcctgcctggctcccagctctgtgggaaccctgggttcctagatattttcccagcctgggcctccagcctcccatcatttctgcaagactccatatacccccattcaatacttcttccaccttttttttccttatgataatcagagtagttttctatttcttgcaaacaagaattttcattgatgcaacaaatttcaaagcctgggtataaataaaagtcaacattttaccctgaattatcaaggcgaccaacaggaaccagttgtagggtgatgcaacctttaaataatgttttatttgaagctattctaatagctattgggaagccatatcaactatacacttctgtaggatctaacaaatacaatttgcccaaatgtatttgcttttggcagtcatctctaaatcagccagtgatggcacatactgtaactcgattctgtattttcagaatttgtgctgccatttgggaatctgaactttgacattattggaatgagcaattctaatgttttgggaaggtggggagaagtaaatcaacaggcatgtaattggtttcgatactgtgcttttcaaaactgaaatgtttgcaatgctgttattagctgagatactgtagatagttttacatgttgggaacaattaacacgtgtcctgtgggtctgattattagcgttaaggaagttctgctctgtgtaaaccccaaagcaaagcctccaggaaagttaaaggtccctgttctaccattaaaatgggaaagtaatgtgcccttttttgattgactataaactttgacttgtgggactttgttctccaaggtgaaaacaaacatgagtacaagacaagttgttttccttaaaaattcaatctttagcagaaaccatgtatcagaaaatttcttaaaataaaactaaatcagtattgcctttatggctaacacaggaaaaaaacaagttaaaaagctaaggtggcaattttccttaaaatacagcacagaaaaaattttgcatgtttaggacattgcccagaagactgataaatttgatatttgatatgtgaaaccgttggaggcattgcatgaaaagttgtaattataaaagattttaggagtaattaaatgattgaacgtaaatttatgagacatcctggtttttatgtgtcatagatccttgaaatacaaaagtaattaggtgagattcacacaaacacagtaaattaaatgtattactagtaatgtagagtaatattcagattctccattatatgtgagtagaaagagagtcgtaaacctggccttctgctcccagcttctttcctaacaccaaataactaacctgaggcccagtttcctcacatgtaaagtgaaaaacatggactacaagagttcagtcttctataagtgctggaaacctcgacgatcctgaagttaatcttttaataagtttaatcttatgtgtttatttatttttatttttttctcactcatggactcaggtcacaaatatgtttaatcttttgtgtagttgtttgattatgttttttttttttttctcaagatgaaggagaaaaggaacagaaagaagtgtgatgtcaaagtagacagtatactccaaagtgcctcgcctctgagtggatttaggaaggcagaacccccctcctctatatccttccagtcctcaaaagacaggtggggggcattgttcctctagcaactatcacccaaggcaaagagttagtctcttcaaaacacagggaaatcctggtgtcaaaatggaaagtgctgggctaaagaagtggtttctgcctctgtcacaaacagcctcgtggctctgaacaaattccacagcctcggtaggcctgttatcttccatagtggaaggacggctttccagctctttctttttttcatccaaagaacctgtgttttgggtataatgacctaacttacctagtattttgaggttaagtttcctttaatttgccaaaaatattatcattccaagtgaaaatagagagctccaaagtcaagaccaagtttgtcatttttaaacccccacaggccagagctggaccttccctccaagaaaggaaataaaagagctaggcacatggtcaggcaaactgttaaagctgtgggaagacagagagattagacatttttctaccaaaggcaagaaacttgtaagaggaaagtgaagaaaataaaattagaggcaaagggaagaagtgggggaggaagaaggaaatagaataagtgcagcccctccggcccggccgtctttgaagtgaggccagaactaccgcaaaggattgtgggagacgaggtcaagagaaaaagtagatggagaccctttgctcagaggttaatagttacgtgtcagaagtgttttatcagagtaaaatgccctgtgcatttttagatactttttagaggagtaaaccaattctgtggaagtttcccaaggtccttaggaaagaggagttctatggtttataacctaaaaaaaacaaaaataacggtattttggaattacagagtctgttttaattagcaataacaacaaactatggaagagacctggtatttcatatttaaaatgggttcgaaacaaactagttttgtttttactttggggtgcaaggggtgggcgagtgaagcctctgatcgtgatctggagagcccattaattgctcaccagcatctgctctgtttctacaagttctgtgccatgtagcactgtaaattatgaatgagaaagatgatctttgctcttcttaggacttctgactcctaagccatgctagacaaaggtcatagctgaggtgaatttcagttagctttggcaaaacccattttcttgttcagatagctgaatagatggttgtgcaaaattagcaaaggttactatgggagcattaagaaagtttaccaaaagggtagcagacagtagttcaagcaatatttccttgaatgagttatccaaagggcttcaaatcataagttccagggagatagttttttgttttgttttgtttttaaaataagaatactaaacattttcctttatgtttggcttatttctttgtgtgaaagtgatgcggtcgagtttttatttgtgtagctctcctggaacatgctgtcacgcagccactcacatgattaagagggctcgcaggaaacctccacctctgactgtttaatttaccaggacttttaaaagcaagactgataaaattcataaatttatcacatctctagcggctgatgacactcatcaagtctgttcctgaaactctttggttctgtgcttttgtaaagcggggtcactgatgacaaacctaatgcagaacgatcaagtcataactaacttttaaatgtttccttgaaggttaagaccagaggatctgaataaaaaagtagcaggatccttgctctgatctttcctgacatttcccaaatccacaaggcagagggcatggtgcagggttggagagtaaactgttccatactcagctctcaatgaggagcaccggcaagctagtttttgcaggcaggtaaagaaataaacatacacacattatgggactaatatttgatttgcctgtgggtgtatttttaataagcttatcaaaaacacatatctgcaaagaatatttaagagcacaggtgtaataaataatcatataattgcaaaatgctgagatgcaaatttctattgtttgatgcattttttaaaaaaaatgctctcattcttctagcttttcccagtacagctgttatacaaaaggaactgatttaattccttttaggattatgaagatggttggaagcctgtttaagattatgttgcctcgtcttttaattgttggtcaacatttcaaatagaatgcaatatattttgtgcccgatgacaagcaaactacatgtttcttataggatggatggttacttgtctttgtaaaaccaaatatcattctctgaaaagcaggtcaggtaatgctagccttagttaatagctgggggtaccttgagtacctctcaaatcaataatgacagaggtagcctgatagcaatttatgaaccacagtcctcttgggaaacatatttcaaaccataacttcatctaaactgtttatcggctaagcttgctcaaatgtatgaagtgtcaaaaagtttctttgacattaggcttgttattgtcctttgatttatgcacttaagcaaaatgcagtaaataaaaagattggtggtttagtattttaaggaaatgattagaaacatttgccaatgctattcattttatacagtttttctttccaaattacaaaaatagtgtttcaattcagtgaatggcttcaccataacaaaatcttaaatgatcattatagtaagtggaaatgctgatgaagttactatgaaatagtttaaaaactgtgaagtaaatatgtaatgctcatatataaagcatttgtctctctcctttaatttcatatgcctggcagtttacaaaatgtcccataataatctaaggcacatttatggttgtgaatttaccttattaaaaacatagttggtttttgcagaaactttcatatgaaaaatacagaggacaattctcttggaaagcatccttcaagaaaattattgggcttagacgaaacattttgatttgctaggaaatgaaaatactgacttttcagatttcttgatgatggaatattctagaggtacaaaatgcatccaaagtcaaactctaagacaaatcttttaaacaagatttcatttcaatattgtagtttatgattttacatttcatttcagtttgaagcttttcattcttacaattgcttaaccacattttcatattaggcaactctaggcagttatatatatatatatatatatattatagttggccaaggattccaaatgattgcatgagtttttaaaagcttatttaaaaaaacagatataaatgcaattcacttgcacattgtaggcaaacaagaaacctaatggagacagacacattttaatgcacaggttgcttatatgaggctttatgtgtccaatatatgtttttctgagtacttaactactaagctgatgggtaccagaaaaaaagtcacagatataaaagaacaaatgagttcacagatatctataccagaattgttaacttagcgaatgtttccttgaaaacaggatatagtgaatctgcatatatttaatggaaagtggttgtatttactggagaattaggagaaatgacttcttaatggagccagaagttctgatctgctatccttcaaagaaagactgtttcccaggctggccaaaattcctatggagcaacctatgcctattgataagttatcggattcctctccggaatcagctggtcaggaaggatacagaggggaggaaggggaagggagaggagattccgatagtggcgctgtctgattgccaaggtaggagtgggtggagagttgagaaaggaatagtaagagaggtaaaaggaaagagaacaggaaagaagagaaaaatcaaaaagaaacaaagcagaggccaagcagggtgataatagccatatagaaagggcatccttgtaaatggaacagcattccagatctccaggctcattagaatgggggattgctcacctggattgcatgaacttctcaagtctctgaacccactgaaattgtatacatattttgggagtatgtatatgtgcatttttttctgcctggggaaagtgttcttttctttgatctgattcaccaaggggtccaagactcaataaaatttaagaactactaatttagtgggattatacacaaattttaaagacaagtgtctttaaaggagtcatcgaatgcttaagattgactgtacataatccaagaatgttaccatctagtattaagttgtatattctgggaagagtatcccagaatatcccatgtctttcagacatgtagaatgatagctgttcattgaaatgctattaaaataagtttttttgagacaaggtctcactctgtcgcccaggctggaatgcagtggtgtgatcaggcttactgcagcctctacctcctgagctcaagtgatcctcccacctcagcctcctgagtagctgggactataggcacgtgccactatgcctggctaattttttttgtaattttgtagacacagggtttcgccatgttgcctaggctggtcttgaacttctgggttcaagggatccactaacccaagtgctgggattacaggagtgaaccactgccctggccttcagccaaatactattgattgaccatttgcactaagttaagtcagcatttttctcattgagtgccctgggagtgtggagaaacagtgtggtatgggggaaagggcattaatttggagccagatatttctgggactcaggtactatatggaattcaaactagtttagtgaaactaggaggctgatatggcctccttaactctgtatcctcttctgtaaatgaagaggatgatcattacttcatagggctgttgtagaaatgaaaagaaatgcaatactagcctacatttattggatacttactatctctcattcactatgatatgttttctgtgctttatgcaatttaatcttctcaacaatttgatgagattgatgttatatttatttctattttacagatggggaaattgaggcagagaagccaagacatgtgctaaaggtcatgcaggctatgaatggagctggaatgtgaacgcaggccatatgaccccagagcccatgttcttgaacccttagaaagacagcagcaacacacctggtgcagcagctgcttagttggagtggctgacaaggttggcagaggatcccgttcctcccgtggagtggctgccatgatactgcctgcactgaagctgctcctatttctgaaatatgtattgttatttttttccctgcatgttgaacattatactcttctgttctttcgcattctcttcttcccttccggatgacttctagggtttttgtgattctgtaattctaaaggagaaaggataataagaattgtgaggccgggcgcggtggctcatgcctgtaatcacagcactttgggaggccaaggtgggcggatcactaggtgaggagatggagaccatcctggctaacacggtgaaaccccgtctctactaaaaatacaaaaaattagcggggtgtggtggcgggcgcctgtagtcccagcaactcgggaggctgaggcaggagaatggcgtgaacccgggaagcggagcttgcagtgagccgagattgcgccactgcactccagcctgggcgaagagggagactccatcttaaaaaattaaaaaaaaaaattacagaaaattagctgggcgcggtggcgggcgcctatagtcccagctactcgggaggctgaggcaggagaatgacgtgaacccgagaagcggagcttgcagtgagccaaaatcgcgccactgcactccagcctgggcggcagagcgagactccgtctcaaaaaaaaaaaaaaaagaattgtgatgtgagtgtccaaaaaaaccctgatttccaatcacctacacatggctgtttcctagatacaccagaaaaaattgtgactttccggatacctagtttccctccctccctccctccctcccttcttccctccctccctccctccctccctccctcccttccttccttccttccttccttccttccttccttccttccttccttccttcctcccttcctctctctttccctttccttttccttttccctttcccttccattcccttccccgctttttatttctggatacctggtgttctatcagaatgagatctgcacaagtattatcctagcaacacaggatcccacctactcaacacacctttaaaaaactcctcgaattggctgggcgcggttgctcacacctgtaatcccagcactttgggaggccgaggcgggcagatcacgaagtcaggagatcgagaccatcctggccaacatggtgaaaccccgtctctgctaaaatacaaaaaattagcggggcgtagtagtacgcgcctatagtcccagctactccggaggctgaggcaggggaattgcttgaacttgggaggcggaggttgcagtgagccgagattgcgccactggactccagcctggaaacagagcgagacaccgtcacaaacaaacaaacaaacaaacaaacaaacaaactagaactgtacatttttttttaagttagccaactttctgtgggcaattacataatgtgagcaggcattatatgactttgtgctttacattcaaagaaagttcaaagcttttcttcttttggagtggtttccttttcccccaagggatctgggtaatattgatgtgtttagtgtattcaaatcctagaaaagcacatatataaaaatgtaagtttcttttaattaaacctcctttctttttttgttttttcttagtactgttcatcaaaaaaatggccaggtctggacttaagggaatcttattcaaagttttgggagatttgaaaagatatgtccccgttgaaatagagtcttgttttttcttctaggagagaatgatttccaggaagagcggaacacatatggaaggccttagcttatctttagcgcctcatacacccgttctggacttcagaaaggccagtgagtgggattaggcctcagagataggatgtcagtcccagtgagggatggcctagagcattctttaattctttcctttgggtcacacataagaaacaattttccagcactgatgagtgttattaacaatgagatgggatagaatttagttttccctatggctgtgcttcaaaaatagaaaagctgtcttttctctggaatgattgaatgaagctctggggaggaaaaggtggattggcagatctcttaaaggaagcttctccttctaggcactattctaaggcttaatattttaactccctatattaacctagttcaactaaacagtgatctgagtaattttatttttattaaagctcagatcaaaatgccattaacattgattgagaaaatcaaaggaatctttgatgtgagtggttaaattgctgaattatttcagtcccataccctcacagcatgagtacctgatctgatagacttctttggaattccttttttgtttgagacagagtcttgctctgtcgcccaggctggagtgcagcggtgtgatctcaaccattgcaacctccacctcccaggttcaagtgattctcatgcctcagcctcctgagtagctgggattacagatgtgcaccaccatgcccggctaattattttgtatctttagtagagatgaagttttgccatgtgggccaggctgttctcaaactactggcctcaagtgatctgcccgcctcggcctcccagactgctgggattacaggcgtgaggcaccgtgcctggctgggattccataataaatccctctgtgtctatttcttttttcaaatataattttcttcatttccaaacatcatctttaagactccaaggatttttccaggcacagtggctcatacctgtaatcccattgcttggagaggccaaggtggaagttcatttgaggccaggagttcgagaccaggtgggcaacatagtgaaaccttgtctctacaacataaaaaaaaaaataaaaccctaaggaaataatggtgcctcactacctttcaaagcttttgaccttcaagtcagaaaataaattatttttaggaaaggcatctcaaccttatttacaaatgaactatttgtcaagagcaacctctataaggataataggacttcctggtttgaaatgcagcatgaacaattctcagaggctcctggaagactaagaatgaggtttcttgatccgccttccctcggcatcttctcactctcttccctccttctcagaagctgtgtgcagcaatgggctatgcaactggtttcactggtgcctggtagaacttttaattcctccctgtcagcacatccctagtccactttcatagtttggataaggactggataagcagctgaacttctggggacttttccaaatgaaattcaacctttagacctttggaggtttacccagtcttcctcactacccgaagatgagtttggaacaaattttctcttaatggattctatttgtgggtaggagaggtaatgactgccttgctcagagtcatgagcataacttcaaataaggaaaaagagcctcgcaggaatgtgagaatagatgcgatcctgaggaaggtgtgtctgaggaggtgctgggaggttctgatcggctgttgaaggcagatactgtatctcacgtgacagaagtcacctcctgacatcagagttgtgtttgagtggtaatttaaaaaataatatagctgacaaggaaatgtggaaggcattacgttgcaatacagtgaaatgaacatacaacattcaagatcaattaccgggtactgattagctgggagaaaggcaataaaactttaaaaatagaattggtagaaatagcaccctgtcaaggtgggactgactatgcctcctgctggtttgttgcgaggaattctttttttgggaaaatcctgttgaattgtgtggcttgtgaatctggctctagaactgttaatgttataagaattgaaagaggactatttaaaaataccaagacatcttttaaaattcctatttttagaacagctacttgtcattaaaataaatcattccatttctatttgtccaggttactgctttcacagcagggccagggctatggtgaagtgtgggaggtgcccagtccccttcactgcagtcatggctctgtttcatgccacatgtgttattttataagtggttaagccccacataggcatgcaaacatggtacatctctatgtattggttttggtaatgttgtaaataattgggagaatacattaaaatttggtaatagtgctcctttggactcagtctctttttttttttttaagacagagtttcgctcttgttgcccaggctggagtgcaatggcatgatcttggctcattgcaacctctgcctcctgggttcaagcaagtctcctgcctcagccttcctgagtagctaggattacaggcatgtgccactatgcccggctaattttgtatttttagtagaaaaggggtttctccatgttggtcaggctggtcttgaattcccgacctcaggtgattccagttctaattccccaacagagttgtcttggttgcagtgagatatatatatatatatatatatatatatatatatatatatatatatatatatattttgagatggggtctcgctctgtcgcccagtctggagagcagtggcgcgatcttggcttgcagtgagacatttttatccatcctgatcacagcacttgcctccgggctcatgaagcccagcatgttactgctgttctgaacgtctctgctttttgagagacatgtttaatgaattgggagtatctgtgcacattgcattcacttaaaaagggaaaaataccttttaacagttatagctacagaaattcaatttagtttatttaggaggaaatgagagacttgaattgtaggtgtgaaatcttacaatctttcagaatgatttggtttgggggatggttggaactgcatggaattccttcagccaaaataatttttgtgagcacattcccaagctcacgatcatgttttgataagaaaaatccctttctccacaagttctcaggtcccactcattggcccctgccctcatttctggaacctatgttaggcagttatgtggctcagttcttggtgatatgttttcaatttgagtcaacttgatgagagaaaaattactaaaaagtgggaatgagctgtgaggtgaacagggttttcctatcaaagtggaggtatttttaaaagcatttattatttcaaactcaaacatttatagaaagccatgagtgtgaagtgtatgattaccagttgtggcttgctgcattgaaaaattcaagttcataggaaatatttactgaggctctggtttgcaagcagtttgttcaagagaacaatttggtccagaaggcatgtcagccaaaaaagagtttactaatatagtagtaacaggcaattaggattcataagcatcgccatggctgagacatgatttaaggtcttagatggaaagagttctgttattaagataacagaatttaaatgctgtatctgtctaggtcttatgcatgtcagaagtgagaaaactacttcttcattttccatttttatgagctctgatgtaacacagtttttttttttttctgtgttgaaaatgatgaatatagttcttggcacatttgttccatagtaaagaagaatttaacttgcaagtgaaaaacctctgcctttggccatggattaaaaagatgttatatgatgaagtttacttcctaaggaaaggttagttttgtgtggcactttctgaaaatttgtttgggacatatacaattcttttgtataaattctggaggtctgaggaaaattacttaatcacattagatgagaacatttctttttgtgtgaattgagttcttatcaaggttctgatgttttttctcatgtatttgcccttgggttcatctcaatacaatgcatttgtgtactattgaataaaaagcaggctgcaacagtatttatgacatatgatcctatatacacgtaaaatcttgtgtgtgtgtttgtgtgtgcacatgcatataaaaaaaactacattgttaaagttgttaatagttaactcccggtggtgggttttaagtgattattattttctttgtataagaaaaatagtgcacagttttcttttgttgttacgaaaggtgtcatacatttgaaagaggacatatgcacagtttaaataataataacatagtgaatacccactgcttggctgaaaaaaataatttattactctgttgcagaaggcaagccttccttctgcccctgcctctgtcatggaggtagctacttgcttgaattttgtgctaatcatgtctttgctttcttatatagtttagccagctgtgaatgtctccataaaacatacacagttttattttgattgtttttgaactttaaataaatgaaatcatactggatatattcttctgtgacttttcctttttttttgcttcttattttttggtcattcatccgtgtcaatgtgtgtatctgattttttttctttgaatgtgaaaaatatttcaatcacacagatcaatcaagttacagtcattttgaaaaaggaaaacctcatacgtacatttaaaaatatgtgctgaaacagtgctgaaataaccaggcttttgtgagtgaaaatttttttaatccattcatatatgtccacatgttgatggtataacagctgccttcagaatattatttttagggatcactggctgcacccataacacagaaatgcctccttttcctgcccctgccattaagccactgtgtctgaaattcaaccattagctatttttccctgaggattttaggaactgtcttccaaaagagaaattgtgtcatgcggcgattcaacatgagctagtttagccagtgatcagctttattaccttgacagagaaagagcaggtcttaaggagcagaggaagggggtgggggtagctttagaccttgaaatgtttagagggcgagcttcagtgtggcactgaaatgaggactcagaataaacaaggtatggaatcagtcttagggttcatccgcatacacagtggaatactatgcagccataccatgttgctgtcatttgcagcaacatggatgaatatggaggcccttaagttaggtgaaataaaccaggcacggaaagacacatactgcgtgatcccactgatatgtgaaatccaaaaagttgaaaccacagaggcagagagttgaaatggtggttgccaggggcctgtgagggtggggagaaacagtgttgttgatcaaaagagacaatatttcagttagtcagaaagaataaattcaagagatctatttaccgggcggtgaccgcaggtaataataatgtatggtgtatttgaaaattgctgagagtttttcagtgttttcaccatagataaatatgtgaaataacatgtatattaattagcttgattgagccatttcacaacatatacatatttcaaaacatggaattgaacaccataaatatatagaacttttatttgtgtattcaaaagagtttgggaatcgtaaaggaaagcaaagatgcagtgaagaggcaacatccaggtgtatgcgatgcagagaaaggagttgggaatgcaacactttagccacttgatgaccgtgcccatatgcagtgacaagcacttcttgagtacctagtgtatcaggttttgtgctaggcattcacaattgaaaatataagaagtaaggcagtcctttcttttaaagaactcatggcctagcggaggaataagatacaccagcaatctttgctccaggtcccagatgattactgagtgggcacaaaagaagaatggactggtagtaggggagacttcaaaaaggagtgatgcttgaaggatgcgtctggtgggcatagaaggggaggtcattcccatcagagagaaggccatttacagaggtacaggggtatgagattatggagtccagtgacttgctgacacatgtgactggagtggtggggccatcctgcaccgccaaagtgatggctctgcagcctgaccttgtcactcgcccatttgaaatcatgccatacctctcctgcacagcacatattattacacttggcctcggtcccacctctcctactgtgcttctcaaattagtttccttaaatggttctctgcatcacaactttcttatttataaaaatagagaatgacatcagagcacctaaactcagctttctgtttttttccacagagatcctggcaaatgggtgtttcttcccagaaagggatttttctccatgactgcagttgaattgcagagttgtagagacatccaggttcttgttagtgtggacgaactatccatgaagatcttaaatgcaggagtctatgagaacaccaattaatcaattgtcaaatatttgagtatctattgtgagcaaggcactgtataaccattatgtcatgtattaatctattggaaaataatttgaccttggttgtatagtattttgtttatttttaccttaaattttgtaactctattataagtgtttacataccaactatttgagggctgtatgcaaggtatagttttattgtactttgcttcttctgttacaataaagtacaagtacagtaaaataatcatatctggctggtggtggtggctcatgcttgtaatctcagcactttgggaggccgaggtgggtggatcacctgaggttaggagttccagaccagcctggccaacatggtgaaacccggtctctactaaaaatacaaaaaattagctgggcatggtggtgcgcccctgtaatctcagctacttgggagtctgaggtgggagacttgcttgaacccaggaggtggaggctgcagtgagctgagaccctgccactgcactccagcctgggccacagaacaataccccgtctcaaaaaaaaaaaaatcacatcttaccaatataagctaacacatcatcattttaaagaatattagaatcataaataagaaagcttgaaaatgttaagaatcaaataagcccattatctagaaataaatagaacttgctgtgtaattcaattaaatttgatagagcaaataattactggcacctgtagtaggcactgtggagtacgccaagctttccatgagacgctccctctaccctctgtacttgttagtgtattgcgaacctatgttctctgtactgaagaaacagagaatggagaatttcccatccttctctctagtctcaatttccaaaggcaaccttcctataatttcactctcttgcataggaaattcatacaaagtccatcagccctgtaattagtctagagcaagcggtgaaaaagtagggatgagaacaggcagatttagcaactcatgttgaagtatccaccttactccagaaactggtagtgactataatggatcttttcctctgctactcttttactttcatgcccagacttaacgttatcagtctagaatttctgatactccagaggaaacccgtatgagatactgcatgtggctctctgacctcattctccctgcccaaacttctgagatcccaccccaaggaaaggctgctgaattgcagcaagattatactcaaaaccatgtcctgtttctttccaggtcttttgtaggatgtattcattctggggaataaatagaaataggaaaatctccactactaccaccttagtccaagccattacaccattacatgtctcacctggttattgcaacacacacacacacacacacacacacacacacacacacacacacatatgtttagagacagagtcttgctgtgttgccaaggctggagtgcagtggtgcaatcacagcttactgtaaccttgaactcccatgctcaaactatccttctgcctcagcctccaagtaggtagaactacaggtgtgcctcaccatgcctggttaatcattttttagctttttagatagaggtggggtcttgctatgttgcccaggctagtcttgaactcctggcctcaaatgatccttccacctcagccctccaaaatgctaggattacagatgtgagcccctgcatcaggaatggctattgcaatattcttctaactggttaacctgtttctgttctagacattccaacacatcaggcatgctgtcacctcaggccatttgtacttgctcttccctctgtctggaccacatttcactctattttgggctctatcctgcagtgtctctgtactgaaatgtcaacatcctcagtgaggatttatctgggctactttatatgaaattgtaactcccaggccttatgtttcctaatcccattccaaattttatttttcactaagttatttattgtcatcgaatgtattgcatatttaaaatttttactctgtctattctctgtctctcactacatgatgtaaggtttgtgaaatatttttgtctgttttctcaccattgtgttcccggtgcctgaatggtactgccacatagtgtcacaaggtatagtttttattgtactttgcttcttctgcttcaataaagtacaaatacagtgcaagaattctgtcttaccattacaagctaatgtatcatcatcatatatttgatgacaaatatatgacaaactatatatatatataaattcatatatttactgcttcaacaaacatacatatacatatatttgtcgaaagaataaataaataaataaatgtataaaagaagggacttactcctaccttatacatattttttagaatactctagttccagtccaaaacttggttagaacaacacttagttttcacttgagcaaagagaaccaattccacatttgcacctggtgttttctttgttacagatcacaacattcagtgtttgaattttgtcttttctagcttaagagaagaatgttgagggcaagtttagtaatttctgacttttctcacatttttgaaagaggcacttgcattagaaagtaaaaaatctttacgctttccagaaataatccctttgaggaaacatctcagaaataacgtttaaacgtatctttgtgtaatgtgcatatactaagaaaaaatacctctttaagtagattagggctgcttttaataattgaagtgtgtgatcacatttcaaactcagttcttcatcttgatcttcagatatttaacagaatatttgggtcagatggtcaacaactgcacatatttcttttttcttctttgacttaagtgaagggagtaacaagagagttttctctgcaggagaaagagttgggggtggggtggggagtcaacaaatatgtcccaccacctgtttctataaagttttattggaacatatccatgcccatttcgtaacttgttgactgtgcatacagcctatgctcactttcatgctaaaacagctgaattgagtagttgcaacagagatatgactttcaaagcctaacataattgctgcctggtcctgtataaaaacaattgtggatccctgacatttgactataaccaatactagttgggaaggccagtggaaaggcatgtggccacatggaggaggctaaaataaaagtgtttgataaataatccagaggatggctacttagttcttaattaatttgtagttacatattttctcgatttgtacaattgctgagatctgttacattatttgtaaataaaactatcctcgttgacatattataattcagaactgtttcattttagtttcggattcatttccaagtaacagtgacttctgccactaatttgcaattattttacagctttttagatcaagtgctactccataagcaatactgcattttataacacaaattacacactgatttacctgttttaaatgtgtatcttttaatatatgattaaaattttttgcaagtgagccctgttacagtgattagtttggataaaatcatgtatctttaaatacatttaaaaaaatttatttatttattttttatttttatttttattttttttgagacagagtctcgctctgtcgcccaggctggagtgcagtggcgcgaccttggctcactgcaagctccgcctcacgggttcacgccattctcctgcctcatcctcctgtagctgggactacaggcgcccgccaccatgcccagctaattttttgtatttttagtagagacagggtttcaccatgttagccaggacggtctcgatctcctgatctcgtgatctgcccgcctcggcctcccaaagtgctgggattacaggcgtgagccaccgggcccggccaaaaatatatatttaaaaatataaaaatgtataaaactatgtcacaatgagaaagttgggtagcaataatgctacagtttggcggtccccaacatttcgggcaccacggatggtggggggcaatgatttcgggatgaaactgctccatctagtaagagtgagcaacctgatcctttgcatgtgcagttcacaatagggttcgtgctactatgaaaatctaaagccactgctgacctgacaggaggtggagctcaggcagtaatgctcccttgaccagcgctcacctcctgctgtgcagcccagttcctaaaaggccatggaccagtaccagatggaggcctggggtttgaggacctctgctatagttaatttggttactgcatcagcttctatagaaacaacttgcttcttagattttcttaaaatacagagagtatctatagatttaatgttatgtcatatttttggaacatcaagataaactatattgaaatgcctattgagatgtgtgataagtaatcaaaattaagtactattcaacatctgagaagctttcagaatgtgttacctgaatttgataatctctaggaaggctatactgagaatatttgtcatttcagtataacacaaagtgtcaaatgaaggctttggatatatttattggaagatacagggatatgtgacattttttaatattaaatgcaactctactgatctgaaaaatttagatgtctctgtaaacatactgcaaacagatctacttcagcactttagaaaacagagtagacctctgcccacagaacaggcttgaatggaaaccatcaagtcacaaatagagaatgcatctggtacttcattgttgcagtaaaatctatcattaaatcaaaatgtaaaatttgaatttacagaatcatatatgtgccagctattgttctatgtgctatcctggtgttatctcatttgttcttcataacaacctttctatcctgatgaggaaactcaggcttagagaggccaagtaatttccgaagaacacggagaaaggaagtgatagagtcaagttttgattcattagacaattcgtttgctcctaaagtccagctcttaacctctgcagcgtactgctactctagataatagtaatcttagcttatggaaaatggggtgcggggaatacttaaatgaatcctttcttttcatctgttttcatgttttgcacaatcttaaaacagtgctaaaaacaatgttgtctcctattctcattatgtcttgcacttttcaaccctgcctcccttacttttgcatctctcatgtacttagttgcattttacagaagatccctacaagtaaaagtaaaaactattttttcaaggcattacagtaatccttttcttatttatctttttccttgatttcttaaatataatataaatcttacctattattcacgatttgaaatgtgttttcttattaaagaaaagccaaacaggctgggcgcggcagcgcacgcctgtaatcccagaacttcgggaggctgaggcaggcggatcacctgaggtcaggagttcgagaccagcctggccaacatgtgaaacgtcatctctactaaaaatacaaaaattagctgggcgtggttgtgcacgcctgtaatcccagctatttgggaacttgagacaggagaatcgcttgaaccctggacgcggaggttacagtgagctgagatggtgattgcattgccactgcactccagcctgggggacagagcgagactcgatttcaaacaaaaaaaaaaaaaaagaaagaaaaacacagaaattccagtgttgtttcagacagctgtattatgttgagatgacttagatctggaaggtgttcattctactggaaatttctggcaataaatattttatcttgatttatggtgtggaaataattattgttattttacagatttcatatacttcaattggaagaacaacttttggaaagcatctttcgattgtctgattgtccaggcaccggtcactgccctgaatgatttcaatttaattgaaccatgtggtacttgtgtcaataattttacataatgcttgtaaagagacttgggggtgaaaagtgcaatgtagcagaaacacacgttgctgatataatgccatcagcctaaatatgtcaaggtgatatacaagcacattatttgtacacttttatgtagagccaatcagtatagtgtttagacacaatctggatagcacccttcccctccatgatcacgagaatccttgtgactctttggaaaaaaacctaagttgttttactctgacttcctttctccatctcccagctcctggactgttgcctgagcagaaagtcattacgcagcatgtagaggttgaagagtgtagccacattgtctgctaaatgcacatctggctggaatttttagttctacccttaggattgagaaaacgaggtgagattttgggtaaacagttgatagattcatcaaaacttaattatgtaaatgatcaatgatctactattgactaattaatactctcttcattccagaaaaggtattttacatatccatatgtaaaataagttaaaaggtatgcatgaatagaaagtcagggccagcgcaaatgtaatgtgagggtcgaatctagggagaattagaactattcagaccaatgggagtaaagctgagttcagttggctctaaacttcctggtgactgaggtggaatgggaaacatgattggtgaagcctaaatttaattcattgaaaataaactacgcaaagatttcagtgcattatgttgatcactaagactcaaaatgggtgttacggattgaatgtttgtgttcttccaaattcatatgttgaaatcctaacccctaatatgatggtattagaaggtggagactgtggcagtagttaggtcatgagagtggagccttcaggaatgggattagtgcccttaatcaaagggaccccagagagctctcgctcttttcggaagctgactgtgctggcaccctgatcttctagtctccagaactgtgagaaatacgtttctgttatgtatttatttatttatttgagacagagtctcgctctgtcactcaggctggactgcagtggcatgatctcggctcactgcaatctcctgggttcaagtgagtctcatgcctcagcctcccgagtggctgggattacagacatgtgccaccatgcccggctaatatttgtatttttgtagagacagagtttcaccatgttggccaggctggtctggaactcctggtctcaagagatccacccaccttggcctcccaaagtgctgggattacaggcttgagccacctcgcctggcctccattgtttataaaccacccagtttatgtcactttttgtagcagcctgaaccagctaggacaatgggttagggcttttgtaagtcccacctcgatgtgtcagtaatttttagggaagtgaatggatttattctgtcctgccacaggtaacataactaaatgtattatttctctaccttaaaaggcactggaaagaaaaaaaaattctttttacaatgtaggtcatttaaatatggagtataattaattcacttggcaaatctggccggtcatattcttagttcaattataaggaccaaatccagtgatgttatttaaaactacctggagatatagtatctttctttgcatttgccccagtatattcctgtttctaggcttttatttagtctgtgacctttgtcttaaatatgcctgttaggaactgtgaagggtctgatatattaccttacttgctagctaacaagttagcctgccatggtttcatgaccccaagcaatagcagtagctggtgtattagcatttatgtcactgccccaagctccagttccaacagtgtgaccacccaacagggtgacataaagtgggccaggtgacacctgtacaccccgtgggttgcattgccggagaggaactctgagcttacggaaactaagtgttttataatgggcagttagcatgtctgctccattgccccagagagagatattctttctaccttccaaggtggttagctatacaaacatccctgaaaagatagtttggaacagtgacagttcactcctctgcttgcaagaaatttagaaatgcccagtttgattgctcatcagaaataaaaaagaaaggaaaaagaaaaaaaaagtaatgtaaaaatgtaagacacctatggagaactgtctcctaacaataccctcactacttttatctactgaaatgctattcattccggaaaatcaacactttaagaaccacctcctttcagccttcttggtgcctatgttttagagaaaccttctctctcattgacttttcattgtattatagcctataccaatattttatattaatcatctaatttacacctccctgtgtcttatggtttcacgtattatattttcaaggaggatctaagatctgtgagggcagaaaccacttttagagctattttgcatccactacaatactcaatactgtagatggtatgtagagaatatatatgaggatgtgagaaaaggcaacatttggaaaagttgtccatggcaacaaaatgaaaaatttgtattttgtatccacagtaatattcaatactgtagatgctatatagagaatatatatgagggtatgagaaaaggcaacaattggaaaggttatccatggtaacaaaatgaaaactggccatagtttcctatttgtcatgctatagcgaccaaaaaatggaattcccagactaagaatctgaaggtctatgacttcatagttatagcatgacaggattccacagctaactcctggcttgactttactggagtttaatctcagtgtgttggtgacttgtgttgatttatctctgattaaatataggggagggaagggactctcatgaggcaaggctgactcttttcttatccagaagcttcttggacaaatgggatcatgcaaatgtgtggaagaaaagtctcaacaaggtggaggatgaaattctgggacactatcatacatgtagatatgaattcatccagcaacaaatccatatttacaggaaaagaactatctgcactgtgccagccatgcaagtctgactctgacatgagagaatgagaccagcatgtggctttgaagtatcttggcaatcctcacaaatatttttttccttccatttttcttaaaaaagaaagaggccgggcgcggtggctcacgcctgtaatcccagcacgttgggaggccgaggcgggcggatcacgaggtcaggagatcgagaccatcctggctaacacggtgaaaccccgtctgtactaaaaatacaaaaaattagccgggcgcagtggcgggcgcctgtagtcccagctactcgggaggctgaggcaggagaatggcgtgaacccaggaggcggagcttgcagtgagccgagatcgcgccactgcactccagcctgggcgacagagcgagactccggctcaaaaaaaaaaaaaaaaaaaaaaaaaaaagaataaaatatgtttaaaaatggaaatggaaggctcctctataaaacattaatttatagttagatgtgtgagtggcattatggccaagaggaaagtataggctttggaatgtgttaaaatctggactgtaccacttatccagtatgtgtgtcaggttaaattgtgtgggcttgctgagttatcagtaaatgtggaaaatgaaacccacttcttgagatatttgagaattaaatgggataatgtatatcacatacccattgcagggtctggcaccaaaatgataacatctattattattaagcaattgactcataaggacgattgatggctggaagactgaagaagaattaaaaagatctcttacaggcatcccaagtaggaaatagatgttgatgtaggttttaactataagcaagggtacccaccaggcttcagaaatggaggaaaaaaagatgactgctttctagatggttgtcctagttagtgatggattaaatcaaaccttttagccttcagaaccaaggagaaaaaaaaaaaagaaacaactttgtaaacatcaatctttgtatatttttcatgctgaaagtagacaatttacataattccttctgatataaggctttgcctgagtttcaggttggcttttcatattttttgcatgctttttaggtctccccatttttaatataaaataaaattataatgtagggagtgatgatttctttgtcaaactgaaataagttaattggtaattttccaagatagtctaaagggggtaagttatatttatgtgatctaaatccattggttaaatgcagagggattaacatctgttaaaagagttgtgcttggcatgcaggtgtttcaatatttgcatttagtatgtgtttcagaaacagcctctgagaaaaacatttatataacaatctggtgttttattgtctaaatctgtcgggacagtcattttgttactcagactttgtgaccctcttgcaagccgtaaactatttaacgaagtgagtatattgagaaagatgacagacttccaaactttggggaaagagtattatatgagaagaatcagcttttcctcctgagactgtgcctaatatgtgaacagcaaaaacaattacactggtgatttcaggaagtccaataaattccatagcacagtctcacttttgaaatattacatcactcagcaaaagcttatgttcgtatattaagctgaaatggactaatcattaattaattaccatgagttcagttttgtgaatggagtgcggaggtagggctctggtttcagtccactcagagctgcagggtttaactacggctgcagtttaagtctcacagtgcccatatgtggagggcaagttgatctccttatttcagccgtcttcacgatcacctctcattgtggtgattgacttaaccattttgtaatccacactgttaaaataacttgtgctctggtccgtttgttttgtaggtacagtggggaaaataaatgtagtgcatctccagagatttgtggcttgaaattagaaagaaaatagacaaatcaagtggtttcacacattgccagattatacctcaagaaaattaaaactggataaaagctgaattataagtgagctctgctttataaataaaccacacatggctatgatagcgcatgatggctcactttggcgtcattacttttaaaatgtttaaatgtactcagggtgcatgaattccagtcagaaacactgtcttgtgtgtaaataacaattaacttttaatgttaatgtctgctgtgtggcttgttctcacacaattatgttgtttttgactctagatggttcccaaatcaagttcaggacactttgggcattcaccgaggaagtttcagtggatgcagatttcagatattttctggctttagggaattgtctccccaaaaccactgggtggggcagggatgtgtatgtgaggtcatgtttagacttttgcctgatagcttctggagtggtttgcacttctccagggctagaacagccatctacagttatatttactgaatacaaacactgtcccaaattttgtggccagtctcatgaactctaccttatctctatctctccttcaggtggtttccagaattttgataaaataagcagaaatatctccaggaatttgtggggaggagaacctagttgatggtcagctttcaattttgccaattatagacatgaaagaaactacttttatcacttaataaatggcagtaccttttaataccagtattaagacagttataatcaatgaacgaaaaacagcgctttaaatggagtcaatttaacttttcttttattattatacttaaagttttagggtacatgtgcacaatgtgcaggttagttacatatgtacacttgtgccatgctggtgtgctgcacccattaactcatcatttagcattaggtatatctcctaatgctatccctccccccttcccccaccccacaacagtctccagagtgtgatgttccccttcctgtgtccatgtgttctcattgttcaattcccatctatgagtgagaacatgcggtgcttggttttttgtccttgagatagtttgcagagaatgatgatttccaatttcatccatgtccctacgaaggacatgaactcatcattttttatggctgcatagtattccatggtgtatatgtgccacattttcttaatccagtctatcgttgttggacatttgggttggttccaagtctttgctattgtgaatagtgccgcaataaacatacatgtgcatgtgtctttatagcagcatgatttataatcctttgggtatacacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgatcgccattctaactggtgtgagatggtatctcactgtggttttgatttgcatttctctgatggccagtgatgatgagcattttttcatgtgtctttggctgcataaatgtcttcttttgagaagtgtctgttcatatcctttgtccactttttgatggggttgtttttttcttgtaaatttgtttgagttcattgtagattctggatattagccctttgtcagatgagtaggttgcgaaaattatctcccattttgtaggttgcctgttcactctgatggtagtttcttttgctgtgcagaagctctttagtttaattagatcccatttgtcaattttggcttttgttgccatcgcttttggtgttttagacatgaagtccttgcccgtgcctatgtcctgaatggtaatgcctaggttttctgctagggtgtttatggttttaggtctaacgtttaagtctttaatccatcttgaattgatttttgtataaggtgtaaggaagggatcaagtttcagctttctgcatatggctagccggttttcccagcaccatttattaaatagggaatcctttccccatttcttgtttttctcaggtttgtcaaagatcagatagttgtagatatgcggcgttatttctgagggctctgttctgctccattgatctagatctctgttttggtaccagtaccatgctgtttcggttactgtagccttgtagtagagtttgaagtcaggtatcatgatgcctccagctttgttcttttggcttaggattgacttggcgatgtgggctcttttttggttccatatgaactttaaagtagttttttctaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagagttccttcacatcccttgtaagctggattcctaagtattttattctctttgaagcaattgtgaatgggagttcactcatgatttggctctctgtttgtctgttattggtgtataagaatgcttttgatttttgtacattgattttgtatcctgatactttgctgaagttgcttatcagcttaaggagattttgggctgagacaatgggggttttctagttatacaatcatgtcgtctgcaaacagggacaatttgacttcctcttttcctaattgaataccctttatttccttctcctgcctaattgacctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatatctaatttattgagagtttttagcatgaagcattgttgaattttgtcaaaggccttttctgcatgtattgagataatcatgtggtttttgtctttggttctgtttatatgctggattacatttattgatttgcgtatattgaaccggccttgcatcccagggatgaagcccacttgatgatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattctctctttttctattgattggagtaatttcagaaggaatggtatcagttcctccttgtacctctggcagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcagtggtgataacccctttatcatcttttattgcgtctatttgattcttctttttttctttattagtcttgctagcggtctatcaattttgttgatccttttaaaaaatcagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctctgttctcattggtttcaaagaatatctttatttctgccttcatttcgttatgtacccagtagtcactcaggagcacgttgttcagtttccatgtagttgagcagttttgagtgagtttcttaatcctgagttctagtttgattgcactgtggtctgagagacagtttgttataatttctgttcttttacatttgctgaggatagctttacttccagctatgtggtcaattttggaataggtgtggtgcggtgctgaaaaaaatgtatattctgttgatttggggtggagagttctgtagatgtctattaggtctgcttggtgcagagctgagttcaattcctgggtatccttgttaactttccgtctcgttgatctgtctaatgttgacagtgaggtgttaaagtctcccattattattgtgtgggagtctaagtctctttataggtccctcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattacaacccctgcctttttttgttttccatttgcttggtagatcttcctccatctgtttattttgagcttatgtgtgtctctgcacgtgagatgggtttcctgaatccagcacactgatgggtcttgactcttcatccaatttgccagtctgtgtcttctaattggagcatttagtccatttacatttggagttaatattgttatgtgtgaatttgatcctgtcattatgatgttagctggttattttgcttgttagttgatgcagtttcttcctagcctcgatggtctttacattttggcatgattttgcagcagctggtaccggttgtgcctttccatgtttagtgcttccttcaggagctcttttagggcaggcctggtagtgacaaaatctctcagcatttgcttgtcagtaaagtattttatttctccttcacttatgaagcttagtttggctggatatgaaattctgggttgaaaattcttttctttaagaatgttgaatattggcccccactctcttctggcttgtagagtttctgcagagagatcagttgttagtctgatgggcttccctttgtgggtaatccgacctttctctctggctgcccttaacattttttccctcatttcaactttggtgaatctgacaattatgtgtcttggagttgctcttctcgaggagtatctttgtggcattctctgtatttcctgaatctgaatgttggcttgccttgctagattggggaagttctcctggataatatcctgcagagtgttttccaacttggttccattctccccgtcactttcaggtacatcaatcagacacagatttggtcttttcacatagtcccatatttcttggaggctttgttcgtttctttttattcttttttctctaaacttcccttctcacttcatttcattcatttgatcttccatcactgataccctttcttccagttgattgcatcggctcctgaggcttctgcattcttcatgtagttctcgagccttggctttcagctccatcagctcccttaagcacttctctgtattggttattctagttatacattcgtctaaatttttttcaaagttttctacttctttgcctttggtttgaatttcctcctgtagctcggagtagtttgatcgtctgaagccttcttctctcaactcgtcaaagtcattctccgtccagctttgttccgttgctggtgaggagctctgttcctttggaggaggagaggcgctctgctttttagagtttccagtttttctgctctattttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgttttcctgggtatcagcaggggtgtctgtacaaccgcggattttcatgatccacgaatgctgctgtctgatctttcctctagaagttttgtctcagaggagtacccggccgtgtgaggtgtcagtctgcccctactggggggtgcctcccagttaggctgctcggggtcagtggtcagggacccacttgaggaggcagtctgcccgttctcagatctccagctgcgtgctgggagaaccactgctttcctcaaagctgtcagacagggacgtttaagtctgcagaggttactgctgtctttttgtttgtctgtgccctgcccccagaggtggagcctacagaggcaagcaggcttccttgagctgtggtgggctccacccagttcgagcttccccgctgctttgtttacctaagcgagcctgggcaatggcggccgcccctcccccagcctcattactgccttgcagtttgatctcagactgctgtgctagcaatcagcgagactccctgggcgtaggaccctccgagccaggtgtgggaaataatctcctggtgcaccgtttcctaagcccgtcggaaaagcgcagtatttgggtgggagtggcccgattttccaggtgccctcctttccttgaccaggaaagggaactccctgaccccttacgcttcccaagtgaggcaatgcctcgccctgcttcggctggcgcacggtgccctgcacccactgtctggcactccctagtgagatgaacccggtacctcagatggaaatgcagaaatcacccatcttctgcgtggctcatgctgggagctgtagaccagagctgttcctattcagccatcttggctcccggatccagtttaacttttgcagaggtaatttcgtggtctctttttcttatttgaatgacaattttgccatgggttgacatctagcaagagaatgttgagaatcattgaaaaacttcaagtacctttgaattggaatcaggagacctgggttgggggtcagacaccattccatgttagctatgggattctttctgagctttctttgtaaaatggagatggtaacccttgcctggattttctcacaaggctattgtgaaatgcatattgtggaatgatgtatgcaaaagtgttttttaaaccagaaagcacaagcaaaattaggtagttttcttgtaaatttatagaagattatcatgaggtaatagaatcctatggctgggcatagccttagaaattcatctgaaaaaccacctcaccgtgtttctgctgtttgacctttccatttttctttaagaaagatttctcttctattacccagtaccttcagccaaaggaactggaccatttttattcaaatgccaccctgaatattcatgtgtatttctgttgctgaattatctacctgctcctttccatctgaaatgtaaactcttgggatgttgctccccagtaaatgttatctcagttttgacaggaggctgtattcctggttcctggggattgactgtcatagtattcctggtccctgtcagttagggaagggactggttgtggaattcatgaatgaaattgttttctaaaaaatatatagtctgtcatattcctgggctacatcagggaaaacaaaaaccaaaaacttcccttcggagtcacttgtgagctattggatacttgcttgcaaggtatcatttgtcctatacacccttaagtacccaagttaggaagtcactatctgtgggctttggacctctccactttcagtggcagcatgtgccacctttggtctctgaggggtaaaagattttttaaaaaatcgagctaattttaaacattagacctttccctgtaagatctacctattaatactggttccttgaagaaagaaatgctattttttttctttgtgatggctttgagaaaggcaaaaaatttaattcctgagattttattttattttgttgaagccaaacatctataatccctttaaccatttcacatatggaaaaattccgagtcccccaaattcctagtcatcctgtcctgcttctcccaactctcagttgggtgcctttgcttgtgatatgaattgaaaatattttagctcaatttatcttttgccttttcactttgtttataatagtatggtggtttgctgcaccaacaaccatcatctacattaggtatttctcttaatgctatccctcctcttgccccccaccccctgacaggccctggtgtgtgatgttcccctccctgtatccatgtgttctcattgttcaactcccgcttatgagtgagaacatgcggtctttagttttctgtttctgtgttagtttgctgagaatgatggtttccagcttcatccatgtccctgcaaaggacttgaactcatcctttttatggctgcatagtattccatggtgtatacgtgccacattttctttatccagtccatcattgatggacatttgggttggttccaagtctttgctattgtgaacagtgctgcaataaacatacatgtgcatgagtctttatagtagcatgatttataatcctttgggtatatacccaataatgtgatttctgggtcaaatggtatttgtggttctagatccttgaggaatcgccacactgtcttccactatggtggaactaatttacagtcccaccaacagtgtaaaagtgttcctatttctctgcatcctctccagcatctgttgtttcctgactttttaatgattgtattctaactggcataagatggtatctcattgtggttttgatttgcatttctctaatgaccagtgatgatgaactttttttcatatatttgttggccgcataaatgtcttcttttgagaagtgtctgttcatatcctttgtccactttttgatggggttgtttttttcctgtaaatttgtttaagttctttgtagattctggatattagccctttgtcagatagaaagattgcaaaaattttctcccattctgtaggttgtctgttctctctgatgatagtttcttttgctctgcagaagctctttagtttaatgagctctcatttgtctattttggcttttgttgtcgttgcttttggtgttttaatcatgaagtctttgcccatgcctatgtcctgaatggtatagcctatgttttcttctagggtttgtatggttttaggtcttatgtttaaatctttaatccatcttgagttaatttttgtataaggtgtaaggaacgggtccagtttcagttttctgcatatggctagccagttttcccagcaccatttattaaataggaaatcctttccccattgcttgtgtgtgtcaggtttgtcaaagatcagatggttgtagatgtgtggtattatgtctgaggcctctgttctgttccattggtctatatctctgttttggtaccagtaccatgctgttttggttactgtagccttgttgtatagtttgaagtcagttagtgtgattccttcagctttattctttttgcttaggattgtcttgtctatatgggctcttttttggttccatatgaaatttaaagtagtttttttttctaattctgtgaagaaagtcagtggtagcttggatggagattagcattaaatctataagttactttggtcaatatggccattttcacaatattgattcttcctatacatgagcatggaatgtttttccatttgttcatgtcagctcttatttccttgagaagtggtttgtaattctccttgaagaggtccttcacatcccttgtaagttgtattcctaggtattttattctctttgtagcaattgtgaatgggcgttcactcatgatttggctctctattattgctgtataggaatgcttgtgattttgcacattgattttatatcctgagactttgctgaagttgcttatcagcttaaggagatttggggttgatacgatggggttttctaaatatacaatcatgtcatctgcaaacaatgacgatttgactttctctcttcctatttgaataccctttatttctttctcttgtctgattgccctggccagaacttccaatgctatgttgaataggagtggtgagagagggcatgtttgtcttgtgccagttttcagagggaatgctttcagcttttgcccattcagtatgatattggctgtgggtttgtcataaatggctcttactattttgatatatgttccatcaatacctagtttactgagagttattagcatgaagcggtgttgaattttatcaaaggacttttctgcatgtattgagataatcatgtggtttttgtcattggttctgtttatgtgatggattatgtttattgatttgcatatgttgaaccagccttgcatcccagagatgaagcagacttgatcctggtgggtaaactttttgatgtgctgctggattccatttgccagtattttattgagaatttttgcatcgatgttaatcagggatatgagactgaaattttctttttttgttttgtgtctgccaggttttggtatcaggatgatgctggcctcataagatgagttagagagcagtccctctttttctattatttggaatagtttcataaggaatgttaccagtttctctttgtatctgtggtggaatatggctgtgaatccatccggtcctgggcttttttcggttggtaggctattaattactgcctcaatttgagaacttgttattggtcaattcagggatttgacttcttcctggtttagtcttgagatggtgtatatgtccaggattttatccatttcttctagaatatctagtttatttgggcagaggtgtttatagtattctctgatggtagtttgtatttctgtgggatcagtggtgatatcccctttgtcatttttttaaattatactttaagttctagggtacatgtgcacaacatgcaggtttgatacataggtatacatgtgtcatgttggtttgctgcaccaatcaacttatcatttacattaggtatttctcctaatgccatccctcttccagccccctcccccctgacaggccctggtgtgtgatgttcccctccctgtttccaagtgttcttattgttcagttctcacctatgagtgagaatatgtggtctttggttttcggtccttctgatagtttgctgagaatgacggtttccagcttcatccatgtccctgcaaaggacatgaactcatcccttttttatggctgcatagtattccatggtgtatatgtgccacattttcttaatccagtctatcattgatggacatttgggttggttccaagtctttgctattgtgagtagtgccgcaataaacatatatgtgcatgtgtctttatagtagcatgatttataatcctttgggtatatacccagtaatgggatttctgggtcaagtggtatttctggttctaggtccttgaggaatcgcaacactgtcttccacaatggttgaactaatttacactcctatcaacagtgtaaaaatgttcctatttctccacatcctctccagcatgtgttgtttcctgactttttaatgatcgccattctaactggcgtgaaatgctatctcattgtggttttgatttgcatttctctggtgaccagtcatgatgagcattttttcatgtgtctgctggctgcataaatgtcttcttttgagaagtgtctgttcatatcctttgtccactttttgatggggttgtttgtttttttcttgtaaatttgtttaagttctttgtggattctggatattagacctttgtcagatgggcagattgcaaagtttcccaaattctgtaggctgcctgttcactctgatggtaatttcttttgccatgcagaagctcttcagtttaattagatcccatttgtctattttggcttttgttgccattgcttttggtgttttagtcacgaagtccttgcctatgcctatatcctgagtggtattgcctaggctttcttctagggattttatggttttaggtctaacatttacatctttaatacatcttgaattaatttttgtataaggtgtaaggaagggatcgagttttagctttctacatatggctagccagttttcccagcaccatttattaaataggggatcatttccccattgcttgtttttgtcaggtttgtcaaagatcagattgttgtagatgtgtggtgttatttctgaggcctctgttctgttccattggtctctatatatgttttggtacaggtaccatgctgttttggttactgtaggcttgtagtatagtttgaaatcaggtaacgtgatgactccagctttatactttttgcttagtattgtcttggcaatgcaggctcttttttgcttccatataaactttaaagttgttttttccagttctgtgaagaaagtcattggtagcttgatggggatggcattgaatctacaaattatcttgggcagtatggccattctcatgatattgattattcctatccatgagcatggaatgtttttccagtttgttgtgatttctgttcttttacatttggtgaggagtgcatcacttccaattatgtggtcaattttagaataagtgcgatgtggtgctgagaagaatgtatattctgttgatttgggatggagagttctgtagatgtctattaggtctgcttggtgcagagctgatttcaagtcctggatatccttgttaaccttctgtcccattgatctgtgtaatattgacagtgggatgttaaagtctcccattattattgtgtgggagtctaagtctctttgtaggtctctaaggacttgctttatgaatctgggtgctcctgtattgggtgcatatatatttaggatagttagctcttcttgttttttttttttttgaaatttaaggaaaaaatttaatgaagatctgaaaaacaattcctaaaagattgacttttccagaaaagtagctacacaatgcattgcatctatcatgttaaaacgtgcattagacacaaatacaaaaactgtgaaacaagccattcttcaacaatttgagccaagataaaatgcctaagtaacaacatggatgacttgcaaaggatgggctctttactttaagcaccattaaaaaaaaaaaggagcacaaatggatgagtgtattcagttatatacactgaattgaacctttggcactaggaatcagagcattttgtcatgtagcattaacacgtattataaaaatgcatagtgttaaaggaatagaaccaccagcattcaaaagcagctttgtcaactaggcaataaaacactctacagcatatccctgtgttgtccatcattgaaaacactggcagcaactttgaaatgaaaaaaaaaaaaaaaaaagagaaaaggagctattaccccttttattttctctgtttaaaatcaaacagaaaacaaacatcaattgttatacactaacatcttcaaagcacatcgtttgtacaagagatagactaagaacaaaaatgtgtttatggagatccagacataagtgagtgagagtgcctctcacacagctttccgatggtactcaggaagagccacttcataatcgctggcactaaacaaagttgcagaattctttgccaggtactttaggaaatcgtgaagataattgagtaataaagcaaggctcttctcattcagaggtgtataggccaacattgctccaatttgtacagataatctcaggagatgtggcactccatacacctgggacatgggtgcatcgggacaatctgcaagaatttcggcatactgtggtctctcaaatttgttgagtagctgggtgcccaacattaggttgaagtattcttttatccctgccacaacttcattaactgcatactccttattatctgtgtttccatgagatttcttgtaatttgcatagtcctcaagaatggaatccacattcttctcggcaggaagatagaagagctgtttttgcctggtaattaagtcccagtcatcaacaagccatggttttagctcttcaggaatctttactttaacttcaactctgttcatgaatgtttcctcattttcaacagtaggatctacctgggcccttttctttcgaggaggctggggagtctcactggtactgccaccatctccatttccaggtgttttctgtttgttcttttttgttttcacttcaatatttttctgttgcagaccagatgtcttctttcctggggcagcccatctcatcttcccctctgcatactgctcctgattggctttttgaagttctcgctgtttctgcaaattggtgtccacatatttgagtactctgctctccggaacccactcatcccaatttttattccaaccactgtaatgtataaagtatttcactttttgtcctttatggcaacctttacacactttgcatcataaagcagaggcccatgaaaccacagcactcgctcaccctcctggaatttaggcttcgggtcctgcttcagcaccatttataagtgatttgccacctcctccttcagcacttcttgttgaattgatccctttaccattatgtaatggccttctttgtttcttttgatctttgttggtttaaagtctgttttatcagagactaggattgcaacctctgcttttttttgttttccatttgcttggtagatcttcctccatccctttattttgagcctatgtgtgtctctgcacgtgagatgggtctcctgaatacagcacactgatggtcttgactctttaaccaatttgccagtctgtgtcttttaactacggcatttagcccatttgatttaaggttaatatgatgtgtgaatttgatcttgtcattaggattttagctggttatttttcccattaattgatgtagtttcttgctagcattgatggtctttacaatttggcatgcttttttgcagtggctggtactggttgtttctttccaggtttagtgcttcctgcaggagctcttttagggcaggcctggtggtgacaaaatctctcagcatttgcttgtctgttaaggattttatttctccttcacttatgaagcttagtatggctggatataaaattcagggttgaaaattcttttctttaagaatgttgaatattggtccccactctcttctggcttgtagggttcctgccgagagatcctctgttagtctaatgggcttccctttgtaggtaacctgacctttctctctgacttcccttaacatttttttcttaatttcaaccttggtgaatctgacaattatgtgtcttggggttgctcttcttgaggagtatctttgtggtgttctctatatttcctgaatttgaatgttggcctgccttgctaggttggggaaattctcctggataatatcctgaagagtttttccaacttggttccattctccccatcacttttaggtacaccaatcaagtgtggatttggtcttttcacatagtcccgtatttcttggaggctttgttcatttctttttactcttttttctctaaacttgttttctagctttatttcattaatttgatcttcaatcactgataccctttcttccacttgatcaaaccagctattgaagcttgtgcatgcatcacaaattctcgtgccatggttttcagctccatcaggtcatttaaggtcttctctacactgtttattctagtttgccatttggctaaccttttttcaaggtttttatcttcctcgtgatgggttcaaacatgatcctttagcccggagaagtttgttattactgaccttctgaagcctacttctgtgaacttgtcaaagtcattctccaaccagctttgttcctttgctggcaaggagctgttttcctttgaaggagaagaggcactctggtttttagaattttcagcttttcttctctggtttcgcaccatctttgtggttttatccaactttgatctttgatgttggtgacctacagatggggttttggtgtagatgtcctttttgttgatgttgatgctattcctttctgtttgttagttttccttctaaccgtcaggtccctcagctgcaggtccattggagtttgctggaggttcactccagacactgtttgcctgggtatcaccagcagaggctgcagaacagctaatattgcagaacggcaaatattgctgcctaatccttctgaagctttgtcccagagaggcaccctcctatattaggcattggtcagcccctactgggaggtgtctcccagttaggctacacaggagtcagggacccacttgaggaggcagtctgtctgttccagagctcaaacaccatgctgggagaaccacttctctcttctgagatgtcagacatggacgtttaggcccgcacaagttgtctgctgccttttgttggctatgccctgcccacagaggtggagtctatagagacagtaagccttgctgagctgtggtgggctccgcccagtttgagcttcctggcagctttgtttacctactcaagcctcagcaatggcggacacccctcctgcagccaggctgctgcttcacagttcaatttcaaactgctgtgctagcagtgagcaaggctctgtgggtgtgggacctgccgagccaggcatgggagagaatctccttgcctgacggttgctaagaccttgggaaaagtgcagtatttgggtgagagtgtcccgtttttccaggtacagtctgtcatggcttcacttggctaggaaagtgaaatcccttgaccccttgcacttcgtgggtgaggcaacaccctgccctgctttggctcaccctccgtgggctgcacccactgtccaatgaatcccaatgagatgaaccaggtacctcagttggaaatgcagaaatcacccatcttctgcatcaatcacactgggagctgcagactggagctgttcctattctgccatcttggaatgaagatccccttggtaatttttttgtctgtctatttgattcttctctcttttcttctttattagtctggctagtggtctatctattttatttatcctttcaaaaagccagcacctggattcattgactttttgaagggttttttgtgtctccgtctccttcggttctgctctgatcttagttacttcttgtcttctgctagcttttgaatttgtttgctctttcttctctttcttttgaatttgtttgttcttctctctttctagagaaggacatcacttcttttagttgtgatgttagggtgtcgattttagatctttcctggtttctcctgtgggcatttagtgctatgaatttccctctaatcactgctttagctgtgtcccagagatcctggtatgttgtgtctttgttctcattggtctcaaagaacatctttatttctgccttcatttcattatttacccagtagtcattcaagagaaggttgttcagtttccatgtagttgtgcagttttgagtgagtttcttaatcctgagttctagtttgatttcactgtggtctaagaaactgtttgttataatttccattcttttgcacttgctgagaattgttttacttccaattatgtggccaattttagaataagtgctacatggtgctgagaagaatgtatgctctgttgatttggggtggagcattctgtagatgtctgttaggtcttcttgttgcagagctgtgttcaagtcctgaatatccttgttaattttctgtctcgttgatctaatattgacagtggggtgttaaagtctcccactattattgtgtgagagtctaagtctcttcgtaggtctctaagaacttgctttatgaatctgtgtgttcctatattgggttcatatatatttaggatcattagcttttcttgttgcattgatctttttaccattatgtaatgcccttctttgtcttttttgatcttgttggtttaaagtctgttttatcagagactaggattgcaacccctgctttttttttgctttccatttgcttggtagatcttcctccatccccttattttgagtctatgtgtctttgcacgtgggatgcatctcctgaatacagcacaccgatgggtcttaaatctttatccaatttccagtctgtgtcttttaattggagtctttatcccttttacatttaaagttaatactgttatgtttaaatttgatcctgtcattatgatgttagctggttattttgcccattagttgatgcagtttcttcatagtgttgacggtctttacaatttggtatgtctgcagtggctggtaccggtttttcctttccatatttagtgcttacttcaggagctcttgtaatgcaggctgggtggccacaaaaatctctcagcatttgtttgtctcttaaggattttatttctcctttgcttatgaagcttagtttggctggataggaaattctgggttgaaaattcttttctttaagaatgttgaatattggccttcactctctttggcttgtagggtttctgcagagagatccgctgttagtctgatgggcttccctttgtgggtaacctgacctttctctctggctttcgttaagattttttccttaatttcaaccttggtgaatctgacgattatgtgtcttggggttgatcttcttgaggagtatctttgtggtgttctctgtatttcctgaatttgaatgttggcctgtcttgctaggttggagatgttcgcctggataatatcctgaagtgttttccatcttggttccattctccccatcagtttcaggtacaggaatcaaatgtaggtttggtcttttcacatagtcccatatttcttggaggatttgttcattccttttcatccctttgtctctaatcttgtgtttgtactttgttttattaagttgatcttcaatctctgatatcctttcttctgcttgatcaattcaggtgttgatacttgtgtatgcttcacaaaattcttgtgctgtgtttttcagctccatcaggtcatttatgttcttccttaaactggttatcctagttagcaattcctctaatgttttctcaaggttcttagcttccttacattgggttagaacatgctcctttagctcagaggagtttgttatttctcaccttctgaagtctacttttgtgaattcatcctactcattctccatccagttttgttcccttgctggcaaggagttgttaaactttggagaggaggcattctgatttttggaattttcagcctttttgcactgttttttccttatctttgtggatttatctacttttgttctttggtgttggtgacctttggatgggtttctgtgtggacatcctttttgttgatattgatgctattcctttctgtttgttacttttctttctagcagtcaggcccctctgctgcaggtctgctggagtttgctggagttccactccagaccctgtttgcctgggtatcaccagcagaggctgcagaacagcaaagattgctgcttgttgcttcctctagaagctttgtcccagaggagcacccaccagatgccagctggagctctcctgtgtgaggtgtctgtcgacccctgctgggaggtgtctccccatcaggaggcacggaggtcagggacccacttgagggggcagctgtcccttggcagagctcaagcattgtgctgggaggtccactgctctcttcagagccagcaggcaggaacatttaagtctacttaatctgtgcccatagccgccccttcccccagctgctctgtcccggggagatgggagttttattggggctgctgcccttctttcagagatgtcctgctgacagaggaggaatctagagaggcagtctgcctaaagtggctttgaggtgccgcggtgggctccactctgtcccaacttcctggtggctttgtttacaccatgatggaaaaactgcctactccagtctcagtaatggcaaatgtccctcccaccaccaagctcgagcatcccagattgacttcagactgctgtgctggcagcaagaatttcaagccagtggatcttagcttgcttggctccattggggcaggatccactgagctagaccacttggctccctagcttcagccccctttccaggggagtgaacggttctgcctccctggcattccaggcaccactgaggtttgaaaaaaaaaaaatctcctgcagctagcttggcatctgcccaaatggctgcccagttttgtgcttgaaatctaggtccctggtggtgtaggcacctgagggaatctgctggtctgtgggttgtgaagaccatgggaaaagggtagtatctgggctggaatgcactgttcctcatggcagagtccctcagggcttcttttggctaggggagggagttccctgaccccttgcccttcccaggggacatggcactccaccctgcttccacttgccctctgtgggctgcacccagtgtctaaccagtcccaatgagatgagctggttacctcagttggaaatgcagaagtcattcaccttctgcattgatcttgttgggagctgcagagtggagctgttcctatttggccatcttgctcacaacctctataatatgttttaaggttgggttgtgcgatgcctccagctttgttcttttgcttagcattgctttggctattcatgctcttttttggttccatgtgaattttaagatttttttttctatttcagtgaaaaatgacattggtattttgatagggattgcatcaaatctgtagatcgctttgggtagtacagtcatttcaatgatgttaattcttccaatccatgagcatgaaaggtttttctatttgtttgtgtcatcttcaatttatttcatcagagttttatagttttccttgtagaagtgttttacctccttggttaaatttactcctagatattttaattaattaattaattaattaatttgcagttaacattaataggattacattattgattttttccttggctggttcattattgatttatagaaacactactgatttttctatgttgattttgtgttcttcaactttcgtgaattcattgagcagatctaagagtttatttttttggtggagtctttaaattgatttagatataagattatgtcatctgcaaaaaggagcaccttgccttgctcttttgcaatttagataccttttatttctttctcttgcctgatttctctggctaggacttctactattatgttgaacaggagtggtggaagtggaaatctttgtcttgttccagttcttaaaggaaaggctgttaacttttctccattcgatatgatgttagctgtgggcttatcatatatggcctttattatgttgaggtatgttccttctaggccaggtttcttgagattttatcactaagggatgttgaattttatcaaatgctttttctttatatattgagatgatcataatggtttttctgttaatgtgatgagtcacatttattgatttgcacaggttgaaccatcccacttgatcatggtatattatctttttcataggctgttggatatggtttactagcattttgttgaggatttttgtatttatagttaccgaggatattggcctgtagttttctttctttctttctttctttctttctttctttctttctttctttctttctttctttctttctttctttctttctttcttttctgtgtcctttttttgctatcaggttaatgctggcctcatagaatgagttaggaagaattcccttctctaattttctggaatagtttaaggagaattggtgctaattctttgtatgtttggtggaatttggcagtgaagacatccagttctggacttttatttgttgggagactttttattattaattaaatctcattatttgttattggtctgttcaggtttttaaaatttcttcctgattcaatcttggtaggttgtatgtgtctaggaatttacctattttctctaagttttccaatgttgtagtgtatagttgttcttaataatctctgacgatcttttgtattgctgtggtatccattgtaatgtctcttttttcatttctgattttacttgtgtctttttttcccttggttaatctacctagtagtttatcaattttgcttatcttttcagaaaaccaactttttgtttcatcgatccttcgtaatgttaaacctcaattttgtttagttctgctctgatctttattatttcttttctgttaattttgggcttggtttattcttgcctttttagtttcttgaggtgcactggtagattatttatttgaaatctttctacatttttgctgtaggcatttattgctataaacctctcttagccctgcttttgttgtatcccataggttttagtatgttgtatttagattttcactgtttcaaaaaatttttttatttttccctttaatttcttccttgacccagtggtagttcaggtgcatattgtttaatttttatgtatttaaacactttccaaagttctgttgttattggtttctaggtttattctattttgttctgagaagatacttgatataatttcaatttttaagattcttttgagacttgttttgtgtcctagcatatggtctgttctggagaatattccatgtacttacgaaaagaatgtatattctgtagcttttggatgaaatgtctgttaggtccatttggtccaatgtgcagtttaaatataatgtttctttgtttattttctgtctagataatttatctaatgttgagagtggggcgtttatgtcaccaacaattattgtattggaatctatctctcccttatatttaatatttgctttatatatctggatgctctggtgttgggtccatgtttagaactgttatatcattttgctgaacggatccctgtatcattatataatgacctctcatctctttttactatttttgacttaaagtatgttttatctgatataaatatagcttctcttgctaatttttggtttctacttgtatgaaatatctttttctatccctctattttcagtgcatatgtgtctttataggtgaagtaagttttttatagacagcatatagttgagtcttgctttttaaaatccattgaaccagtttatatcttttaagtggaaagtttaaggtttacattcaagcttattaatatgtaagtgctgattcttgtaatgttattaattgatttctgattattttgaatatcctttatttctttcttcctcttttattgtttatcattgtggttttttgtagggatagcacttgagtcttctattcctcatttgtgtgcttgctctaccagtgggttatataattttggtattttcatgatggtagataccatcctttcactactatgtgtatgattcccttaagcatttcttgtatggctggtctagtggtgatgaattccctctgcttttgcttttctgggaaagactttatttctcctttatttatgaatgagaacttctgggtggtgtatccttggctggcagtcttttttccttcagctctttgaatgtattgttgcattctctcctgacctgtaaggtttctgttaagaaatctagtgttcatctgatggggcttcctttataagtgactagtcacttttcctgtttttataatttcattttttgtctttgacttttgacagtttgatgataatgtgctgtgaataagaagacattttgaaattgtatctgtttggaaatatttgagcttcttgcatttggatgtctgtatctcttgctagacttaggaagttttcagctactattttttatataggtttctattcccttcattttctgttccctttctgggacactgagaatttgaatatttggtcactttgtggtgctccatatgtgatgtaggctttgtttcttctttagaattctcttttctttatttttttgtctgactgggttatttcagaaaaccagttttcaagttgtgaagttttttcttctgcttaatctagtctattgttgaagctttcaagtgtattttgtatttcattcaatgaattcttcagttccagaatttctgtttgatactttttaatgatattgatctatttgctaagtttctcattcataccctgaattgtttttctgacttcgtttattgtttttcttagttcttttgtatctcactgagcttcaatattatttttaattctttttccaggaatttctggaagaaattcataaatttcttaattgaaatctgttgctggagaattattgtgttcttgtggaagtgtttatattttcttgcttttccatattttttgtgtccttatgttgatatatgcacatctggtgtaatagtcatctcttccaagtttttgacttcgattttgtagggaaagactattttctaaagacgtatctatggttctgtttatgtagggcactttcgctttgattccatgtgtgtatacactagtatagtccccatatggtttcttcagctataaacacatcagtaatgtctctgattttctcagtggattaggttgcaatttttagtggaggccatgtttaaagttttgctggggatggagacatcacatggtccagttctcaggacccattggtcacggtggcaggctaagtgtgcctatcactgggcccctcggcagtgtcatgggcactgatgttagcaggtccaggtgcatgagttttggacctctgggcagcttactcaggtgtggaagcagtggcaatgttaatcaggcaagtgggaaggtccttgagcccttgggcagtgggcatgacatggacaatggcagtagcagtggtgggagtaccctctggcttccatgtggtctgtgctggtgttggtggtggctgtgacggcctgggcaggttagtttctgggcctgcaggtggctttggtggatgaatgccagctgtggtggtagtggcaggttggttgggctcatccttaggccactgggcatgtgcttgggcactgcgaaggagtatacagttggggcaggtgggtctgttctcacactcattggtggtgtctgtggtagctggctgtggtaggcaaggatggggtgattcccaggcccctggtggaatcttcaggaggggggtggcagtggctgtgttgtgaagatggggttcaatacatcttcagatgagtgtggcagtgggtctgttgtgaaggtggcacctgctgctggtgaagatggggttgcttttagtggcagcagccacaaacagacggctggggagcacatgcttcagcaataaatggtggctatatgcagggtaactttcctcagggcacttttaaatgtatgatggctctgctattggctgtggtgtggtcactgccagtggctctgtctttggtcctggtgagagcagccagcaatggtacctgggtatgatcagtggatgtcaatggggctttggagatatggaggtgtaggagttactgggctcctaggtggaatgcattctggtaggggctgggccttcaggatagcaccttgtgagtaccagatgcctctagtcagctgtcttaaatccctttcaatattattattattattattattattattattattttcttttttttattattatactttaagttttagggtacatgtgcacaatgtgcaggttagttacatatgtatacatgtgccatgctggtgtgctgcacccactaactcgtcatttagcattaggtatatctcctaatgctatccctcccccctccccccaccccacaacagtccccagagtgtgatgttccccttcctgtgtccatgtgttctcattgttcaattccacctatgagtgagaacatgcggtgtttggttttttgtccttgtgatagtttgctgagaacgatgatttccaatttcatccatgtccctacaaaggacatgaactcatcattttttatggctgcatagtattccatggtgtatatgtgccacattttcttaatccagtctatcattgttggatatttgggttggttccaagtctttgctattgtgaatagtgccacaataaacatacatgtgcatgtgtctttatagcagcatgatttgtagtcctttgggtatatacccagtaatgggatggctgggtcaaatggggtttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgattttcatttctctgatggccagtgatggtgagcattttttcatgtgttttttggctgcataagtgtcttcctgacttcaagctatactacaaggctacagtaaccaaaacagcatggtactggtaccaaaacagagatatagatcaatggaacagaacagagccctcagaattaatgccgcatatctacaactatctgatctttgacaaacatgacaaaaacaagcaatggggaaaggattccctatttaataaatggtgctgggaaaactggctagccataagtagaaagctgaaactggaccccttccttacaccttatacaaaaattaattcaagatggattaaagacttaaacgttagacctaagaccataaaaaccctagaagaaaacctaggcgttaccattcaggacataagcaagggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggatatgaacagacacttctcaatattatttttaaaactaattttctcctagtattttcatggcttcacttttcctatttaattttttatgcacttgaatttactttttagtaaatagtaagatagagatcacttctttttttaaaaaagaaaatgctactagctttacaacttattttataatccaacttcttcccattgatatggaattttacctttattttaccctaaaacctcaaatgtatgcaattccatttagaaagttttagttctagtccacagatctatcaatcctggaacatgttatgtcagataaaaatatttttagctttctgtaatgtctggcaacatgtatctgctcatcagtctctatcagaattttgctgattattcttctttttaaaagccgtattgtggtgtaattgacataaaatagactgcatatgtttaacgtgaacaacttgatttgttttggcataggtatatacctgtgaaaccattattacaatcaagataatatattcttgacccccaaatttttgctgtgaccctttgaggtcactatctcttgctccttcctgtctctctcattcccaagcaatcacttactgatcttctttttgtaactatgagattagtttgcatttcctaagattctatacatatgaaatcatatatgtaaagtcttttttctgacttctttcattcagtgtaatttttctttcagattcatccttcttgttttatgtatcagcagttcatactttttacagctgactaacatccttttttttttttttttgagacagagtcttgctctctcacccaggctggagtgcagtggtgcaatctcggctcactgcaagctccgcctcctgggttcatgccattctcctgcctcagcctccagagtagctgggactacaggcgccgccaccatgcccagctaattttttttttgtatttttagtagagaaggggtttcactgtgttagccaggatgatcttgatcgcctgaccttgtgatccacccacctcagcctcccaaagtgctggaaatacaggcgtgaaccaccgcacccgacctctaacattctattgtatgaatgtattagttggcttgggctgccacaacaaaatgccaatagactaggtggcttaaccaacagaaatttatttttcacagtttggaggctgggaagtccaagatcaaggtatcagatgattcaatttctgatgaggtctctcttcctggcttgcagttgccttctcactgtatcttcatatggcctttcctctgtgcatgcacacagagagtttcctctttttataaggccacccatcacattatgagggccccactcacatgacctaatctaactctaattacctctcaaaggttccatctccaaataccatcacactggggactagagctttaatgtacgaattttaggcagacacaaacattcagtccataacaacttaaaaaatccattgaggtattggtggacatatatgttgtttataatttctgactattacaaatcaatctgctattaatatttatatatgaggtatatacctgtatttctcttgggtaaatatttttaagtagaatggctggatcatgtgttgaaataagtggatcatatcataaaaaagttttgtcttttaaaaaaattgccagtttcccaaagtggttgtaccattttctatacccactataattgtatgacagttccatgttatctttgataacacgtggccagtggtaataattttaggcattcttacaggtgtgtggtagcctacatagtggtatctcattgtgcttttaatttgcattgccctaatgactaatgatttcgagaacattttcctatgtttatttaccttctgtatgtcttctttggagaagtttctggtaaaatcttttgcctcctcccttttttttgttgggttgtttggtttctcattattgaattttgagagttctttatatagatataagttctttatcatatatacaatttgcacacattttcttccaacctgtagcttgtcttttctttctcttagaaattttttttgaagagtggaagctcttaattttcatgaagtgtaattatcaatttcttcttttatgtattgtgtttttgctgtcataactaagacatctttccctaacccaagactataaaatttttttttctagaagttttatggttttcagttttacagttaggactgtaatccattttgagttaatttttgtgttttgtatgaggtatggatgaaaattcttttttttgcatattgtaaattgtattgtttaaaaaattttaatttctaatcatttctagaatacctaaataaaactgattaatcttgctaaagtcacttattagcaacagtagttatttctttggtaattttcaagcaattttttacgtagaggatgattttgccaggaaacaaaggcagtttctttcttctttctagtttagatgccttttatttctttttcttgtcttattgaactagtcagaactttccagtccaatattgtatgaacatggtgagaaaaggcatcattgcctttttcctgttcgtaaggaaaaagcaatcagtcattctccattaaatatgatattagctttaagttttttaaatagatgctatctatcagattgaggaagttctcttctatccttgctgtgctaagagtttttagcagaaacgctgaattttgtcaaacgctcttcctgcatttgttgagatgatcatatgatttttctttttaggctgttaatatggtgaattacattgattgatttttgaatgttaaaacaatcttgctttttgtaaatgaatcctattcagccatgttgtgtcatcttcttatatgtaatgtctgtctgtttttcatattcccaagcttctggcctcatgaaagaaggtagaaaatatttcatcttcttcaattttctgtaagaggttttgtagaattggcatcatttgttccttaaatgtttggtagaattctccagcaaagtcatatgggcctggaggtgttttttgttttgttttgttttgttttttgttttttttttgtttgtttgggagggtggttaaattacaaatttaattaatttaataggctatttagattatctatttatacttggatgaaattagtagtttgtgtctttcaagaaatttacctatttcttctaaattgtcaaatttattggcataatgttcattataatattttcttattttaaaaaatatatgtaaaatatgtagtgttgttacctttattatttctgacaatgggtaatttgtgtcttctctcttttttcctctgattggcttggctgcagctttaccaattttattgatctttttaaagaagtagcattgggtttcattaatttttcattgactttatatattttattaatatctactctgattttttcataagttatcttcttctactttggttttaatttgttctttggcttctagtttcttttctattttcttattcccttttttaaagatattttaaatgtaactttattttgataaaggaatgggaatgacagtaacaaacaagatttcaccactgaatattgtgatgtgactgtagcagtctttttttttggacggggggatggagtctcgctctgttgccaggctggagtgctgtggtgtgatctccactcactgcaacctccgactccctggttcaagcgattctcctgcctcagcctcttgagtagctgggattacaggccggcaccaccacccctggctaatttttgtatttttagtagagacagagtttcactatgttgaccaggatggtctcgatcttctgacctcgtgatcagcctgcctcagcctcccaaagtgctgggattacaggcgtgagccactgcacccggccgaatgtagcagtcttatatttgaaactctaggaatcaactgcattccaaaacagctaaatatgcaggtccaaacaatgaaggtattttttaaactgccacattcactccgaagcccactcatctccttcagcatcccacagatgaagcacatgttccgcttagctagataacaatgaggtggcacgcacgctgcaccgctgacatcacaggacaactgcctataaaactaagacttctgacactgggctccagcttcattctcacaggtcattatcctaatccgggagagcagttgtctgagcaacctctaagtcgtgctcatactgtgctgccaaagctgggtccatgacaacctccggtggggagagagcagacatggcaacaaattccaagtcagggtctccaatgggctacctagcaagccagtggaagggcttttcaaagttgtagttacttttggcagaaatgtcatagtactgaagattgttcttttggtggaagacaatggattttgccttccctttcctcttcttaatatccactttgttgccacacaacacgatggagatgttttcacacgctctcacctgatctctatgccagataggcacatgtaagtaactcttgatgttacatcaaacattataatggcacactgggcttggatataatagccatctctcagtctaccgaatttctccctgctggctgtgtcccatacattgaacttaataggtcctctgttggtgtggaacactaggggatgaacctcaacacctaaggtggctatacacttctcaaattcaccagtcaaatgatgtttcacgaaggtcgttttcccagtaccaccatcaccaaccaatacaagtttgaactggacctggggttctccctgtctagtcatcccggcgttctttccagaagcatctccgcacccttccacctgagctcttattcctttttttttttttttttttaattgggtctcactgtgtcacccaggctgaagtgcagtggtgtgatatggctcactgctgccttgaactcctgggctcaagcaatcttcctgccttagcctcccaagtagctgatacagtaggcacgtgccaccatgcctggctaagtttttttttttctttgtagagacaagatctctctccattgccaacactggtctcaaactcctggcctcaagcaatcatccaacctcagccttctgagtaccgggattacaagtgcgagccactgtgcccagctcctgtttctactttcttaaggtacaagttgaggtcattgatttgagatctttccactgttctaatatggatgttcagtgttatggatttacctccaaatattgttttaattgcatctcacaaaatttagaatgtgtgttttctttttcattcagtcccacataattagaaattttctatttcgtttcttttactcatggatcatttaaaagaacattgtttagtttcaatatacttgaggattttctatatttttttctgtttttgatttataatataatttattgtgctcatagtacatactttgcatggtttggatccttttaaatttatggaggcgtattttgtgacccagaaaatggtatgttttggaaaatgtttcatgtgcacttgggaagaatatatattacagtttagtattgtgggatggattattctataaatatcaattaggtcaagttgattgatggtgttcaactcatattcttactgattttctgtttactggttttattaacaactgaacagggatttttgaaatatctgactataattctgaatttgcttctttttttgttgtactttgatcagcttttgtttcatgtgttttgatgctctgcctctttatcatatgaaatgaccttttcattctcaataataatctatgttctgaaatctattttatcctattttaatatagccatttcatctttctttttatagggttagcatggtatatctttttccattcatttacttttagttaatttgtgttttatattaaaacttttttttcttctgtagcagcatatagaattgggtcttgccttttatttcttaaattcaatctgagaatctctgcctttcactgtggtgtttagaccatttacatttaatgtgatatttgatatgatgagtctaaatttactctcttgctatttttttctctctattctttgtctattatctttttctctttttttctattttctatttcttatcttttcccatttttaaataattactttatacttccagtttatattcattgttggcttattagttataatgctttgctgtgtaattttagtgatagctttggtgtttatagaaaatatctttaactttttacactctaccttctggtaatatactgcttcatatttttataaaaatattaccacagtatacttccattttctcctccaagcctttgcaccactgttgtcatacattttatttctacatatgtcataaaccccccaaaatattattatttttgcttcatatagtcacgtatcttttaaagatacttaattagtaataaaaatcattttaaaaacatgtagttacaatttttggtgcttttaatttgagcacagattattatttccatctgttatttttcttctggctgaaggactttttatgtcatttcttgtatttaagctctgttagtgatgaattatttcaatttttgtatgcttcaaagagtagtttgtttttgaaaaatatttttgctgtgtaaaagatggcacatgtatacatgtgtacctaacctgcacattgtgcacatgtaccctaaaacttaaagtataataataataaaataaaataaaattatcatttgattttttttcagtactttatatttctctactgtcatctgcattacattgtttctgatgaaaatctaatgccatcctaatgtttgtccctccctaccccactcaggacaactgatgttcctttgtatgtaatgtttttttcttatggctacttttaagatgtttttctctctatcatcataattttaagcagtttgatcatgttgtgacttggtttctttttatttatttatttttgtgtgtgtgtgcttacagttcattgagcatctcggatctgtggacttttgtacttcattaaattgaaaatattttggccattatcttttcaaatattaccttgacctttttttttctttaagaactccaattacatgcatattagacaagtcgaatttgtcacttagctcactgatgactctgttaaatcttttttagacattgtgttttatttgggataatttccattgtctttaaattaactaatattttcttctgcagtgaataatctggcattaatctcatggcaaaaatctcatatttttcttcttgaacattctaattttttatttctagatgtttagatttgtgttatgtttttatttttcataattctgcttaacatgttcaattttacttcttattgtttgaacatatgaaatatagttataataattgtataaacatccattttcattaattctataatctatataatttctgtgtcaattttgattgcttactttttctcattattgttcatattttcctgcttttttgcatgtctaataatttttaattaaatgccagtcattgtgaattttgccttgtgttctgggtattcttgtatttcaacaaatcttctcaaattttgttgtttgaagcacttaagttacttggaaacagtttgattttagcaggtctttttttgaattgggatcaaagtagaattgagtctaagggctaatatttccctagtactatattgatacaaaacccttctatgtactttatacaatgcttttggaatgatgaggttttagactttgttgatgagaataggagctattcttctgcgtgaactctcagtgttcttccccattatccttttgggtggttattttcctggtctcagttatttttcacacacccataagctggttagtacttagttgaagacttgatgtggacactgcagatctctgaagccctctcctctctgtatctctgctctacagagtctacttgctgtggtatccataggctcccagcaacatcttctctactcacggtgactactggactctgcctatgtttttctttcttgtgtcatggcctggaaactctttttagataatatgtaggcaatcataggactcactttgttcattattcccatttctcagagatcaatgttttttgtagcatgaattttaatgttttgaaaattattgtttgataaattttgttgatttagttgtttcaggagtataaccagtatatatggtccttgttactttgtcttggcaagaagcataaatttccgagtatctatttttttatgcaaggttgtagacctaacccttgctgcatgtattaaaatcatgtggagagcttttaaataagaacttgtctctgagattctgatttaattggtctggaatgatgtttgtgtgaagtgtttaagtgttataccccttataccactattgtggttgctttagttctctgttgctttttaattgccacagataacactattaaaagtgtcgcttactttagctaactgatgaccatcaaagtcctttaacagtttgcctgtttatttattcatttatttttagagatggggtcttgctatgttgctcaggctgaagtgcattggtataatcatagcttagcttactgcagcctgaacttctgggctcaagtgatccttctgcctcagcatcccaagtagcttggactacaggtatgtgccatgatgcccagtggtttgcccatattttgacatgtaaaattaagtcatgtcatttggtactcttaaaaaataaaggtagctgaatggatgtttatcttactccatcaggaagattttggtgctggatacaatgcagttgatgagtagtctcattttcttcttactcttaaatgacagttcacaacttacacacatttcatgggtcatacagggtcacataacaaaattggaattagtgtgctttaaattggaaagaaaacagatcactttgatttaatatttacattttaactagaaattttgcacccctaaaaaaactacagtgccctacattttcaaactttattaattgaatcttaacttcaggttctttctaacagatacaacaatcactgtaacttggtgctgaaaatctatctgcctaatacccaacttcattccaaaaggtataatacattttcctagaatatttctacaattacccaatctagttggctgtttaggttgttaactttgttatgctggtgaattatatatgagctttagaaatgaccatctttaagaaattcttttttttaaattttattattattatactttaagttttagggtacatgtgcacaacgtgcaggtttgttacatatgtatacatgtgccatgttggtgtgctgcacccattaactcgtcatttagctttaggtatatctcctaatgctatccctcccccctcccccaccccacaacaggccccggtgtgtgatgttccccttcctgtgtccatgtgttctcattgttcaattcctacctatgagtgagaacatgcagtgtttggtattttgtcctgtgatagtttgctgagaacgatgatttccaatttcatccatgtccctacaaaggacatgaactcatcattttttatggttgcatagtattccatagtgtatatgtgccacattttcttaatccagtctatcgttgttggacatttgggttggttcaaagtctttgctattgtgaatagtgccacaataaacatacgtgtgcatgtgtctttatagcagcatgatttataatcctttgggtatatacccagtaatgggatggctgggtcaaatggtattcctagttctagatccctgaggaatcgccgcactgacttccacaatggttgaactagtttatagtcccaccaacagtgtaaaactgttcctatttctccacatcctctccagcacttgttgtttcctgactttttaatgatcgccattctaactggtatgagatggtatctcattgtggttttgattttcatttctctgatggccagtgatgatgagcattttttcgtgtgttttttggctgcataaatgacttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttctgttgccattgcttttggtgttttagacatgaagtccttggccatgcctatgtcctgaatggtattgcctgggttttcttctaggcaatgatgaggaaatggagtcatcacaagtcctaaatgtagcaggatatcagagagaaagtctgtatcctataagtttgctttagtgatggcatgggacttacatataaaatgtaaaataaaaactgctaacatagagaaatcccactcctaaaatctgctcatcctccctgatttttatatttccatttatagcattattatttttatagtcacctgactagagtcaaagctttggagtaatctttttcttctctttctgtacacttttaatcaatcgcctattacagctaccttttatcaagcatgtagtatctgccagaaattttatgtcatctatgtctcataatgtactgccaggtaagtactattattcccatttgccagatgagaaaacaaaagctcaaataagtgaaatgggtgattctgtgtcactcagtttgtaagcaaaagagttgtaattgaaggccaggtttatttgtatcccaagcccatttctttctgctttataaagttatttccctcaggagatgctgacattctctatgaagtttgtctcttgaagaaactgtattattattttttaagtctcaggaacataaaacatattaatcataattcttggctcatgacacattcatctgtggttcattcatggtcatcttttatttgtttggttttctattttgatactattgtaacaataatacttcaggaataataataacaaatggaataaataataaaagactataaatagccaagctaatcttgagaaagaacaaagctggtggcatcctgttaacctgctttcaaaatatgttacaaagttacagtaatcaaaacactatggcactgcataaagagaggcatatcaaccagaggaacagaatacagaaccaaaagtacacttatgcatacacagtcaactgatcattgacaacagtactaaagatacacaaagaaaagaggatagcctcttccacacacaaaaggatgatattggatgcttatcttttttttttttttttttttttgtgagatggagtctcactctgtcacccaggctggagtgcagtggcataatctcagctcactgcaacctctgcctcctgggttcaagcgattctcctgcctcagcctcccgagtagctgggactacaggtgtgtgccaccacgccaggctaattttttgtatttttagtagagatggggtttcaccatgttagccaggatggtctcaatctcctgacctcatgatctgccctccttggcctcaccatacatcctaatcaactcaaaatggaaaaaagaattaaaattaagacctgaaactataaaaatcctagaagaaaatttaagggatagcttcataacattggtcttggcagtgatttcatggatatgacacaggcaacaaaaccaaaaaacaagtgacactacatcaaaccaaaaagcttctgtacagcaaaggaaaccatagagaaaaagacaaccaatggaatgagagaaaatatttctttgagtctcttatatattttatttcccttaatagatggcaagcttctcggagatagggattattttaaatttatgtgtgtatttctcatcaacataatcatttaccctggtttgcccttaattgtgggaaggatggatgtccactaaccccgggtgttcttcagcaccaatcaattacttttatttttccttctctaagatttcttcttttgttttcatgactcactgtttctccctacctgtgcatggaatatactgatggtggtggtggtagtaggggtaggaggagcagagatgaaagaaggaaggacgggaacttttcaatgcataaggctatagttcccggtggatatacaagaaagtgatataaacacattgatggggagaagatgtcaatatctctgcttgttatttcaagggtaagaagtgactgagatgtaaataagatcaatgaaaagaaggtaggtagagactcccatttcatatcacttcttatgtgctatttatggtgcatcctagatgagcagccgttcttactatatcacataatatcttgcccttgaattgaggattggaatgtagttcacattatctccattttaaagatgaggaaaattatattgacaaatatgtctgaaaactggagaatccatgaagagagctctcccgtttgatgtggcactgtcctaaccacatactttcacaaagaaacacatttcccgaggctctttaatgtttattttgtacgttctcttccttctttcatggcttcaaaggttgctgctgctcttttggagctctttgatttctgagatcctgtttgggtccaggttctcctcttgccaaactcagtatttggagcattaaagcagtgtcagacaaatgacaccttattgaatcatgtgaattctagttttttagatccatttcaattaagttgctcagaaaaagtagctctttctgacatttatttcagagaaaatgccactaatgaaaacactgtagattcatagctcaacctgctctccaataatttgtgtatagtgtgacctaccacatgctgcttttgcagatttacaccttgcatactgaagcccttaggaaagagggagggaacaagggtgggggaaagagtgggagcagagtgtgagagcaagagagagagtgagagtgagccagcgagtgagagagagagactttatttttagctcgacttctaagtcaagcttaggagggcagagagaaaacaatcacaaatgttcatgacattgatgtctaagtgatgaggtatgtcgtgttacttattaagttgttcagagttttagtgacattcttcttaaaatataacatacaggttgaatgcacttaagaaaaattccagagaaaagttatttccaatggtttttttttttttttggtagtggtggtgagggatgtatgttattgatcttataatagaaataatgacttcaaccaggttttctgagaaaattaatgactgcctaaggttaatggtcttcaatctcccagtcagccattaatccccaggaaatgccctgggccttgatcattattgtgtaaataatacaaaagtgggtatagttctcttgtcagatgggaaacataaaccactcttgttctctctctttatgacaataagaataacgtattaggagaaaaaacacaacaactttgctccagtgcaaataaatagtcttgtttaaacaaaattattaaacagaatattgaacaaacttaaactctgtatgtttgagtaggaaataatgggtgacaggaagctcagaattcttaggcagctgtagttagagctatgagtgaggtaaaatggagagccaaatattgattgaagacagtgcaattactgtcatattagagatttcaaattagaatcagagttaaataaacacataagtgactgcattaatggccgcaaacaaaagatagcgctggaagttacttttaaaaatagaacctgatagtttaataaaaatatcttaagtaactacattttctaaaatttcaaataaatattgtgatgaataggaatatttttcttactttagaatatcaaaggatttttatagtcctttatgtgggttattttgcattccaggattttcaaggaggcaaatagcaaaatgaaaagcacgtgcaggaaatcagtatagcagtagcccttatctgccaaacgggatgctactgaggtggagaagccttcagtaggattttcttactttgaatggaaatgtgcttgtgtagcattataactgtctcagattcagctgaaggtctttacattaagtagtttctcagtaaacatttgcaacgtaagtacatgccctcttgccctgagagttccttgtatgtttgggagattaactttttatctcggatacgtgttgcaagtgttttctcccaaattggcatttaccttttaccttattattattattttttacatgtaaaagcttatttttctccaaactctttttttcctcccctggattttgagttttatttggaaaggctttactcacacccagattataaagggattcactgatattttattctagaacttgtaggacttaatttcttttatattttaaatttttatattaagaaattcccccttttatctttagttgacacataatgtatgcatttctgggatacagagtggtatttcaatacgtgtacataattcattttttccttttttgggtttctgattcacacagggtttatcctggtgtttggtgtgaggtgtgggctgcaattgtgtcttcttccaaatgaatctccagttatcacaatactgtttattaaaaagtccatcctgttctcacagatgtgagacactatttcaattaattatattttacatttttatatgtagctggatttacctttaaactttctattctgttttaattgtctagttgtttactcatattcaatgttttgatgtagagaagaccaaatcacttccctcttggctcctttttataaggaacttatcagttaattttgtatatttttctatatgaattttagagccaacttgtctagctttagaaaaaatctcatttatatatatttttggagaattacattacatacatatgaactagaaggatacttgatatcttttttttgttgtgtcatccaaatgaacatcaagcatggtctttccatttgttcagctctgcttttgtctttcaggaatgtttgaaatattcctcatatagattttttacattactgtttgatatgcttttatttttatttttgttgatagtttaaacttctttttctgtcattatatcttctgaatggctattacttatatagaaataatatcattgatttggtgttctaagtaaagtctcatacaatatgcaaataaagatagtttaactttttcgattcttttctttctaattcatttctcttgtttcattgcattagctaataagtttaactctgtgttgaataggaaaggcagaatagcagacatccttgcatcattctcaatttttactggaaatgcctgaagtgtttacctagtaagtaatatgccagatttagagttgcagaaaatatatttttatcaatttaaagaaaaatccttggttttctgttttacaaagtattttatcagaaatgggtttttggattttattaaagtgctttttcagtgtttatgacaatagtcaaataattttttctttagatcttttaaaattgtgcttatactaaaggattttctattatcaaaccactctggcattcatgtaataaactctacttaatcatgatatactaattttgtaatgtgctgttggattctgtttcctactctttggtttatgattttatttattaaaattttatttatttgcttttaaaattttatttttaaaattgataaataataattgtacatgtttctggggtacataatcgtgtttcaatatatataatatagagtgactcagatcaggataattagcacatctgtcatctcaaacatttatcatttctattgggaactttcaatatcctccttctagctatttgaaactatatagtatactagtgttaattatagtcattctacactgccatagaacaccaaaatttattcctcccatctagctataattttgtaacctttaataaatctcttttcacccttcccttttccctagcctcccagcctctagtctcctctgttccattttacttctatgaaatcaacttcttttagcttccacataggagtgaaagcatgtggttaactttctgtttctggcttatttcacttaacataatgtcctccagttccatccatgttgtcacaaatgccaggatttcattcttttttatgcctgagttgtattccactgggcatatgtaccatgttttctttattcattcatttgttgttggacacctaggttgattctgtatcttggctattgtgaatagtgctgcagtaaactttcctcaatattttgaagtgagattgtctattttttttactgccattttattaggtttatatatcaatgctaaattttctttgtagtaaaattttttacagaagttaaaaaaaattttggaaatgtcttctttttctatgcttggaaaaatttaagtggcattccattatctaatctttgaagctttggctaaatacccccttaaaatcatctgcacatagtaaaatttgagggttagttctccttttctcctgtgaaaattgatacaagttttttttgcttggttttgctttaggaaatttgtgttggggtgtgtggttggagaataaaggcccccccagatacccatgccctagtcctcagaacctgtatgttaagttacatggcaaaggggactttgcagatgtgactaagggtagggaccttgagatgagattattctgaactatctaatcatatgagtacttaaaagtaggcagcttttcccttctgggtgagagggatgcaacgtgagagggaattgacctgcacccgttgttgttggctttggaagtggaggaagggccaccagccaaggaataggaatggacttcagaggctgacatgactctcagctgacactcaagaagaaaacagggacagccataaggaaatgatttctgccaacaacacagatgagcagggaatattctcctccagaacctccagaaaggaaagcagtttgcagacaccttgattttagtttagtcagatgcatattaaatgtctaacctatagaactgaaaaataatgcatttgtggtgttttaagacattacatttatggtaactttgtatggcagcaatagaaaactaattattatctggaaagatggggtcaattttgaaaaacgtactttcctatgaaactctctttgtgggattttcaatttattttcatagaattatgcaatatagattcataattttcttttcttttccatttttttttttttgagacagggtctcgctctgtcacccaggctggagtgcagtggcgatcttggctcactgcatcctctgcctcctaggttcaattgattcttgtgcctcagcctccccagtagctggaactacaggtgtgcaatgtgcctggctaatttttgtatttttagtagggacgagtttttgccatgttggccaggctggtctcaaacttctgacctcgagcaaacctcctgccttggcctcccaaaatactgggattacaggtgtgagccactgcacctggcctggactcatgattttcaaagtttcatctctttaagtggttatttctcctttgtcatttatgattttgtctatctatactttcttttcctcaattaagttagctaattttttggttatggctatctttaggtcatctgaaacagcaggctggggtgagaaggcaaaaggccatatttttatctgatctttgccattagaccggccccattgtctcagtgatgttcttgagaggtttgggccagtcttatattcagctaaatcttataattctcttgaattaacctgtcttgtaggactgctaaacttggcaaggaaaaaccagctctcactgatatactgatttttttcctaatctgtctcacccatagaatctatccacatgtgatttgtatggtaaggtattatcacctacagttaatcaaataatgtaccatggcataggaatcaccaacttttcagcctgcaatatctgtttcctttctgatcaccagctgctcactaaattaatatcccatattttaaattttgttaaggtagccccatttctaggtaccaaactctgtgtttgtggagtatgtaatctgctaacaaaataataaaatgacagtgactttaaaaaggtaaaagtatatttgtctctcataataatccaggcataaacaaactaggggtatgatatgacagctctgttatcttctgttgctctatcacagtccctgggggttgctctggtttgtgtggtagcagatggcctgatactgtcatactccaggccttaaggctgcacacatcccctctgcttgcggccagcatggcagaacttaggcatatcctacatctctgcattcctacctgtaatggaaactggaaaacgtagtatttattctcagtacccatttgttcagataaaactcagagataatcttataatggaggaggggaagaatgaacggtgcggccaactgttggtgtatgccacatcccttttctcgtgatgctgcccatttttccttcttttaaaactaggatgttttcttggatttaaatgcttcaaaatttccactacagtgagaatttttattgagaaaaatttaagctagtataatatttcctttaggtttaggttttttccccttatgaaggatagtcctttcattgtatattttatacataataattattgttttaaaaaattagccaataggccaggcgctgtggctcaggcctgtaatcccagcactttgggaggccgaggcaggcggatcacgaggtcaggggatcgagaccatcctggctaacacggtgaaaccccgtctctactaaaaatacaaaaaattagctgggcatggtggcgggtgcctgtagtcccagctactcgggaggctgaggcaggagaatggtgtgaacccaggaggcagagcttgcagtaagccaaggtcgcgccactgcactccagcctgggcgaaagagcgagactccgtctcaaaacaaacaaacaaacaaacaaacacaaattagctaataaaagagaaaatatctgaaatttctgcacattcagaaaaatatcattgtttcaatgactgtatttcacatacttttaaagaaacatacacaaaaacatttccaaagattttatctaaagattaccatatagttatcccgttttcattgagcaaacttcgaaaaaatgcaattttctctttttatcttttctcttgccaactgaataacagttttaatgtttaattgaataaatatacattggcctaggtggtcggatcatttgaggtcaatagttcaacaccagcctggccaacatggtgaaaccctgtctctactaaaaatacataaattagctgggcatggtggtgaatgcctgtaatcccagctacttgggaggctgagaaaggagaattgcttgaatccaggatgtggaggttgcagtgagggatcctgccactgcactctagcctgggcaacagagtgagactccatttaaaaaaaatacacacacacacacacacacacacacacacacacacacacacacacatatgtatatatatatacatcatctgtatatacatttaaacattttggtagtagttggtttagagaaatgggatcatattatatatttctctatctcttacctttgttactttacagtatattgtgaacattttttaaatcattgattataggttaaaattatgtaatttctgcatgttattgaatggtatggttttaccgcaacttattcaaattttttacccattaatggacattcactctttcaccccatttttttccctctgccctaaatactgcatgaaccattcctatataccagtgctttatttccctggaatcagttcccagtaatggggatgtgatttgaagggtatatgcattttaaatcttaataggtattgccagattgcttccccaaaaggctgaaacaatttccaccccctccagcaacgcatgggtatatactttcccacatctccatcagcaacaggcgtaatcacttttaattcctactaataccatatgtttagtaataatctcaatactactttaatttttcactttatagtcactgagtttgtatgtatatgtatttagtatttttaggctatttaaaagtagcataaacatccatgatgttggcctggcgcggtggctcacgcctataatcccagcacgttgggaggccgaggcgggcaaatcacaaggtcaggagtttgagaccagcctggccaacatggtgaaaccccatctctactaaaaatccaaatttagccaggcttagtggcgggagcctgtaatcccagctacttggaaggctgaggcaggagaagcgcttgaatccaggaggcggacgttgcagtgagccgagatcaagccactgcactccagcccaggggacagagtgagactccgtctcaaaaatgaaaacaaacaacaaacaaaaaacaacaacactaacaataacaaaacatccatgacatttttagtattttactgatacatattacactataaatttgcttgtaacaggacacatgaactgtttgagaaataaaaattctatgtacaacttttttttatgatataaaataaccatctaacttaccgttttaatttcagaagcaacttcaaaatttaagtagctgaattaactggatgttttattattgtttaaacccagcagatgactaaaaagttggtaaacttctaccaccagacaagagtttaccaagcattccattgtttcacagtaaacatatatctagttttgtagtgtttaaaaatacttgggttacttttaatcttaaatttcttggtagttaagttagataagggttgattgcaaactcttccagatctatatgggtctatgcagggcaaattgcctgtttcaggaggctaaggttctggtactgtaagtttgaaatgagtgaatagagctaaagattaagagaaataattttattataaaatttagactaatggaatcagtgtaaagacatcacctttgattaagtcaaacattaaaacaattgattatgttaatataattgattctgttaaacattaaaaccagtgttcacgagtgtaaaagtcttgggttaggtgcttgtcagaccagataattttccagtagaattattaatgtatgtattacatatttctcctatttaaaatctgaaatgttacaagacttccttctacgtcatcatgttaatttcaaaatattaccacttggtatagttatgccactctcagctttaaaaatctatttaaataccccactcatatttttatgtaggtagtatatgttaattttgtggtcacaattggaaacattttatttaatatttgaaaagacacaaacttgctttaaatgctcttagaaatttgaagtgtgtgattactgtagctgtatataattgacatacacattatagatgccgaattcagatgcatgtattggattatagtagataatttctcccctagtggcatgtttctgttaaatctttaggggtctattggctgctatatataaagtgtctgaggagcactaggtgaatttttttatgtaaagatatacaaaattgtagccacttgtttttgtgtgatagagacagaaactgatataaatgtggttgtccttgtggcattttaaacaagcaaaaagttaaactgtctataaagaaactgcattttatacgttttattattaaatccaccactgctttgctgactaataaaatggaaaatgtgtgcttttatgggtttataaaaaggtaagctatagtttcatgaaaaatatcttgcacggattgaatacaggtggctacttgtttagactttgaagatgtaaacgcttagtatggatgtctgaaaaaggtaatctggcacaataaaaaaaatcttccgttctttgctcatcaatcctttgggtattccatgtcaaataaatgctacaacaatttatagtaaaagtacacagtggaagtgccaacgttaacactccttaggactggatacctgccagggttttcacaccaatatttaatgtgaactaaaatgtctttttcattggaagtgtgagaggagcttgctttcctatatttggcaacgtgcttatgtgaagtataaagtcaaatgcccgtgatgttctctttatttcaaccatgataaattgtgttcatttgtttaagtgcatgtggcagctttagtgttcaaactataaattttggttaacttctattgacatgctgtattaaacttaagaaaaacaaattacacttcacccgttttaattgactaaatgtgtcaaaaacacagtaagtataacatgaaaggtcagagccttcatctacactgtaatgggtgtcatggcagggatccagcttttcttgtacatttcatttttcatgaagttttaggacaaggcatacgtttaacattcacttccacttctcatttggacttcaaagtttatcacaggctgtgttactaccaagaacacttttctcttgtgctatttaaagttcccttccaactgacgtgcatgcccagagaatactgatgttctcctgtaaacaaggcctcgggaatggattttggcattctgaggaatgaaatgctgatttataagcacgcccatagatcactgtagcactccttggaaaagacctggtttacatatctagtccccccttccatgactgaaccagcaaccacgtggctaggagttggattaaacttggcacactggattcctttgggatctgattaaagttaccagttttaattcttgagctctgtgtccaatggtttatataaatctttatgacttcagtaatttatcagcttgacacctgatgattaatatgattaattaagctctcgctcacctgttgccacacacttctctcttttttccccagtattatcttttggtatgttatcttttgatctcctttctcaaaattaggtccttttcaagagttcaaacattagtttccagtgtgaatttatgtctggaaacactcaaaaaaaaaaagcaggtgtttggaaagtgctatattttgtattggagaaaacagtgattctaactctaaaagtttattccattttcattactatatataagaatctaatttcttagtacacactttgccaataagaaaccatagttttacaccagcattgttgggggattatcaatatttattctgctcgatgaatttaggggaggggaagaataacagagagtcctccttatccaagaagttcagagagctgcctgatggagcctaatcagcagtttggattcttcttaaataaaggaagagaccatcctgccctcccctgtaccacacactaatatcatgaagattctctaagagtgaacctggttttaaattacaggttggcaaactttttgtaaagagccagaaaataaaacttttaggtcttggaggccagctggtccctgtcgtgactactcaactctgccattgacagcacagtcatcgacattatgtaaacagatgagcatggctgagttccaataaatatttagggacaatgaaatttgaatatcatataaatttcatgtgtcatgaaataggcttcttttgatttttcccagccatttaaaaatgtagacaccagtcttagcttgggggccgtatggaaacaccaggttggatttggccagagggccccacactgccaacttcttctctggactaatacaatattaatttctaggttatttcttcgttatttctaaattctagttatttctaaagtccaagaagtttggagtagggatgctttctttcagagtaatgccagcattctcttaaatacaagcatagtttttctcccttcactcatggtttggtcagatcataaatgcattgccatttggaatctagtcgtaggggaatgaggtgtagcaaacacagttgctgtcctccccatactggcttggcactcaggtccccatgtgtatccactctactgcttcctgcagcaggcatgtgagaatctgcctaaggtttctctggccatggcatgcttttggcttgtgggtagggcatgctggaagtgctgtggcattaaggtctcttgggagtaggtttcagtcaacagctgatagagttggaaggtaaatatcccttgactggggtatctctgaggcatagtccgcattgtcccccaagttcctgagtgagaatggagctccacttgcccaaagctgtgacctgccttgttttctgcttcacttccctccttccgcacaggtgcttcccaggatcacctccgaaagaaaccatttgcttcctagattctcaaaagatgatgaactcttattcttattcttagttcttattcttaaattcaaaaacagtcttttgtaaatgatgaaggtggctggcgtgagttgtacatttttttttgtttttgtttttgtttttgagatggagttttgctctgttgcccaggctggagtgcagtggttagatctcggctcactgcaacctccacctcctgggttcaagtaattctcctgcctcagtctcctgagtagctgggattacaggcgcatgccaccacacccagctaatttttgtatttttagtagagatggggttacgccatgttggccaggctgatcttgaactcctgacctcaggtgatccacctgtcttggcctcccaaagtgctaggattacaggtgtgagccaccacgcccagccttgacttgtaaattttaaattcttgctttctctcgtatttaggcagggcttgccgactctcctttgtggacagtggggattttctctttccctcttctttttttcaacccaaaggcagatttcacagatattgtcagccatggagcattccaagaggtggtgtgacatctccatcctggtctcagtgattgttgtgccctgcacagcatgatgcatggcataagaaagtaggtacaaggggattttctgcatttcccacctcttttcttgttcatcctgtgaacaagccaaaggatatcttcatgacagttcactcttccattgcaaagtgtaaaatttgaatgaattaaactgatatggcctctttgaaaaccacatccttgatgaattttactctgcacctagtccactgtggatttccttactggcccttgaactctggcctatccattcacttttcttccaaagcacctgtgttttatggtgctgggatgagttatgccaaaaaataattcttttattttttgatcacctttagaaagtagttaaaagtttttccttgataacactctctcctccatcctcctttcattagcagaaagcatggatatgctttccgaacattacctacttctaggtagtttttgaaaaaatacagcccctttgctacttatagtgtaagtggagaataaatagaaatagccagaagcttttttaaggtaagattttcttaaagaaagagatacaaagtagatagaagcaaaggagtgacactaggattctttttattgcagcaaaggggtggtggtggtggtaaggcatctgaaaatgataaacacaaaattgatcagatagaaaagctatgactacctaaattcagacaaattgaaaaagaagcaaatttgcatattacccaaaagttttttttttttttttcttttaaagaccgggtctttctctgtcacccaggctggagtgcagtggtgctatcatagctcactgcaacctcgaatttctgagctcaagagatcttccagccttagcctcctgagtagttggaactacaggcatgcagcaccaggcttggctaattttttatctgttgaaaagaggattctccttctgttgcccaggctggtctttagctcctgggctcaagtgaccccctgcctctgcctccaaaagtgctgggtttacaggagtgagcccctgagccctgccaaaagtttgtatttttaatagaaggtcctactactattacagtttgaattgtttgatttcaaggaatgcatatttgaatagataattaatgccacattaactctcacttcccatggatgttaaatcaatgttgacttggaccaaagataccttagataggctggcatggagaatgatgtgaaaggctaaggtaagaaggaagatcaaaggtggactaggaattatccctttacaggctatacttacttcagaatgaaatagatgtattcatataggtgtaggacttgaatttgaacctacactgagttaatatgaccagttttgtccagcagttgattaagatatcaaggaaagaaaaaaaacagttaaaaatcattgcatgtcaatgaagaaatatgtattagatgaaatcctctgatttaacattattacaaatatgagtttggatagatcactggatattcttaactcattttatacgtaggccctatcctggatgctaacagtaccacagtgactaggatgaagtctctgcatcttaagcagcctgtagtctagtgaaatcatgagcagcgcccaaaatggaaaacccatcaagtggcttttacttttcgattgttctggccttcaattataatgtggagaattatggtgtggtcttagctttgcctctggtcttagatttttgttgacttcatctatttatccatttattcatccacccactcaatattttttggtagcctaccatgtgctagatcctgtactgagtgcttcagatatcctcatggagcctgctatcttgtctttcaaacaaaccaacacagatttaggaacacattagtaatccttgcagtccaggatttgttaaagttgaattatgggattattgagtgtcaaaaccaaccatatatggaagttaaattatggcagattacagtgtttgaggactgcttgctgacaacatatcactacagttatatgaaaacaggagataatatgaagacagaacatctatactatgtttaaagatttagttggcaagtgttgctcttaataatactcatgtattcaaattcagcccaatgagtttttgtttcctcctggtcatttgaataatccctcagataaagtcttttacattatggaaagatgtccggttccacatgaccactgcctatctcactctatcatttcttgggattctcagctgcacttcatcatatatcatcaccttttagcctgttctggtcactctatctcacacttcatcgcttcttgcattctttgtgagctctcaactctgtcacggaatctatctctgttgtacacgaactcattatttccaaaccaaatatacagtaattaggccttattggtatctagcacagttctttttagttgattaaaacatgaactattcagttcactatcaaaaaggaataatttctgtgataaaatgtggacaagaaggtattgcttgctattacatagtttctaggctttattcctccttatgttgatctgtaaacttgagtaggcaacttattagtaggcacctttgttacattaaactgaaaggaataaagataaatgctgactgccctgttgaggtgtcaccattatgagttggtcatgtagcttttggtgatgttaacttaggaatgttattacattcagtacatttcaaagtagtaaatatcatttttttcattgtctttaccctaaacagcgaaatcatttcctctattctgattgaaaaatccaagctgaatgtttgtgaactaatctggattatctaaaagaaaatctccatgtgagattaaaagtactatttttatatgattggttattttagtagatttttctgagtgaattattctttcaggttttctaatgcaaagttgtcaaagtgtattttattaaataatggaaatggtcatagcaagtgtaatgttgttattcacaataattatactttatgcatttagattctcacattttgctacatgtaatttcccaccctttgctaatataatgatctcaaattacccagatagattttccatcactccgtgtccactagaatcagaggccaaacatttaaaaattcaccatccccacaaggttactgcagtcctttttgcatgcctttgagttaaaatgtgatttgacagagtttaggggagtctggccaggaatgtcaagatataatgttaaagatatggtgatttctgattatttcattttactaattctagaagtcgtgttcatagacatatggtatatctcattgacatgactagctcattatttaattagtcttggtgcaaaatgaatttatactattaaagggggagaacatgcctatagaggcacttttattattatttagaatagtatttattccttagaacattattttatcttaaaaaatcttaaaaaataaaactgccacaaatttagggttactaacctccttggatgcctcatcactctctaggtactaaatcatgatattaatcacatatgttacagctaagcaggcaggtgtgtgtggtcaatttttaattttgtttttattttactctggtctgtggaattctagactttgtttactcagaagatgataagaaaaccctgcttttggagtactccataaacatttacaaaaacaatgcttttttttctttagtcaaaacaatgcattttatttaccttaatgactgcctgaagttgtaactggtttgtactttgaaacactttggtattttttttaacttagggtatgtacatcaaaatacaaatagattgatgggtcttgactgactttagaaactggccttttcaatttaatttcaggaatccaagaaaacaaatgttaaaatttgcggaataagaggaaatggtgttatagaccaacggaacagaatgtggaactcataaataagtccacacacctacaacgatctgatcttcgacaaacctgacaaaaacaagcaataaggaaaggattccctattcaataaatggtgctgggagaactggctagccatatgcagaagattgaaactggaccccttccttatgccacatacaaaaattaacttatggtggactaatgacttaaatgtaaaaccaaaatctataaaaactttgtaagtaaggggtggaggaagcaagctagaaggacgttctataatctcttactgcatgcagacataaagcttaccttatgattgggttcagatggcaaaggagggattactagaatgatgaattttagaagccccacagctggtttacaaaagcacctacctgccaaatcatatagaccattttaggacatgtcaagtagtttagcttttattctgaatgctattgaaagccactgattttaagcagcaaaaggcaagccaggattttagagagaaatgtctgatgatagtaatgcagagtgaaatggagggggatgaaattggaggcaggaagccattgcagaagttaaggtgggagaggatgacttcttggctttagacatggaaaagaagtgaggggtgggcacgataacaagtcaaagatgacatctgaagttcttgttgaggaactagttggaagtaccatttgatgtcattttgcaaatgggaatatagaaggaaatggtattagtttttaaaaattgtcttgaaaaattatacaagctcattataaaaattagatcaatacagtaaggtcataaatgaaagttaaatattatctcaaatctcagaactaagaaatattccttgttaatttctggtacacttaataccagacatgtttctatgaaaaaatatacacatagaaagatagataaattgcaggatttcctcaacttcagatgaatggtttttttttgtgctgtatggaataatagtgcctaaaagcaccctctaaagataagggaaaagattatagaatatttccagaggcattttggttttgtaactatatattacatctctaatattatcctatgaatttgagttgagttttaacattcagaatttgaggtgcttatgggacgttcatatgaaattgtcctttagtgaggtgcatttgtggtcttggatttagagtgagatcagagctgtaaatattgatgcaggcaatgttattgtacagctggaaattcaaaccctgaagaagtaacactggattcatatgcagaatcattgaggcctgagatagaagagcctgtaggggaacttaagcatttagggagtcagtgaaatagatgaccccctcatcccccaaagtgtctatttaggtagaagaaaacaaagaaagatttgatgctttaaaatccagcattgaaaaaaaaatggagaaagttgtctgtagtgtcaaatgtcacagaacaatcaagtaagttaaggtggataattacccattagctgtaacaatttgggaacagcctgaacagccatttggtctcattatgaacagttttgtagagcagcagagacagaaacaaattatagtgattgaagaattagggggtaaagcccactcttaagaaactgggatgtgagtgtcagagaaagctagggagattgttctagagaggaatagagtagagaatggcttgttttctcacatgagatgttagttttaaaagattatcttgaaaaattgtacaagctcgttgcacaaggctcaattgtacaagctcattgtacaaggctcaaatatattatacgcagattgtaaaatctgaaacagtggaagaggctgaagtgtaggagaaagaagagctggtcggtgaagcagagaccctatgtaagtgagagatgtgggttgcaggaccactttgagcaggaggctggatatcccattatctgagattaaatgtgtgtaggcatgcagatatactttcctatttacataagaagacaggcctttaagaatatccttcctaaataatgtttagctgtttgtctctacccaaatctcatcttgaattgtaatcccatcaagggagggacctggagggagggaggtgattggatcatggaggcagctttccccatgctgttctaatgatagtgagggagttttcatgagatttaatggttttaaaagtgtttggcagttccctcctccaaccccttctgccaccttgtgaagaaggtgctagctttccctgtgccttctgatttgaagtttccacagttccccagtaatggggaactgtgagtcaattaaacctcttttgtttgtaaattacacagtttcaggtcattctttatagcagtgtaaaaatggactaatacagagaattagtaccaggagtggggcactgtcataaagataacctgaaaatgtggaagtgactttggaaatgggtaacaggcagaggttgaaatagtttggaggactcagaagacaagaagatgtgggaaaatttggaacttcctagagacttgttgaatggttttaccaaaatgttgatagtgatatggacaatgaagtccaggtggtctcaggtggagataaggaacatattggaaactggagcaaaggtcactcttgctatgctttagtgaagaaactggtggcattttgcccatgccctagaaacctgcagaactctgaactcgagagaggtaatttagggtatctggcagaagaaatttctaagcagcaaaatattcaagatgtgacctagctcattctgaaggttttcagttatatgcattcacaaagagatgatttgaaattggaacttatgtttaaaagggaagcagagcataaaggtttggaaaacttgtagcttgatcatgtggtggaaaagagaaacccattttctggggagagattcaaaccagctgcagaaattttcataaataaccaagagccaaacgttaatagccaaaacaatgggaaaaatgtctccagggcatgtcagagatcttcatggcagcccctcccatcaagggccagaggcctaggagggaaacacggtttcatgggccgggcccagagccccactgctctgtgcagccctgggacttggtgccctgcatcccagccactctagctccagacgtggctgaaaggtgccaaggtacagctcaggctgttgcttcagagggtgtaagccccaactcttggtggcttccatgtggtgttgggtctgcagatgcacagaagacaaaactttagctttgggagcctctgtttagatttcagaggatgtatgaaaacacctagatttccaggcagaagtctgttgcaggggcagagctctcatggagaacatctactaaggcaatgcagaggggaaatttagggttggagcctccacacagagttcccactggggcactgcctattggagctgtgagtagagggccacttccctccagaccccagaaagatagatttgctgacagcttgccgcatgctcctggaaaatccatgggtactcatggcagcctgtgaaggaagctgcagaagctggaccctgcagaatcactggggcaaagctgtctgaggcctcaggagccctccccttacatcggcatgtcctggatgtgagacatggagtcaaaggacattttgcatctttaaaatttaatgactcttcagccaggtttcggacttgcatgggacctgtggcccctttgctttggccaatttctcccatttggattggaaacatttacctaatgcctgtaccttcattgtgtcttggaagtaactaacttgcttttgattttacaggctcgcaggcagaagggatttgccttgtctcagatgagactttggactttgatttgtgagttaatgctggaataagttaaaacttagaaggactgttgggaaggcatgactggttttgaaatgtgaaaaggacatgagatttgggaggctccagggtagaataatatggtttggctctgtatccctccccaaaatcacatcttgaattgtaatccccacatgttaagggagggaactgttgggaggtgattggatcatggagtcagtttcccatatgctgtacttgtgatagtgagggagtttcatgagatctgatagttttaaaggtgtttagcagttccccttctctctctctctctctctcctgctgccttgtgaagaaggtgttgcttcccctttactttccatcatgattgtaagtttcctgaggcctccccagccatgcagaactgtgagtcaattaaacttcttttgtttataaattatccagtctcaggtcgttctttatagcagtgtgaaaatgaatgaatacactaaaaaacctgtgttttatatgttaagaagagggtaagataatctggtgtgaatgagtaaaatgggatttgaaaaaggagtctgaggaattgtaaatgtaaatagtaaatagtaaagcttgttgtggtaaaggcaaaagtagcagcttaaggacacacaaaaggactgctgatcagccccaaaggcttgaccaaagccgaaagcaatatttctttttggtgccagattccatggctatatgattctcttcacagaatgtaggtgcaaaagtggagcacagaaatggtaagattgatccagtgtttttttttcctttattgtcaaggacaatagtccttgacaagagaacatttcaagtgatagaccatgagacttgggccagacagaagagaaatgggaggaagaaaatgagggtttctttgagggtgactttaggtggcaatggcagtagggagtggggaatccataaagagaaagagttgtgactgggagagttggatgtgatattttagatttaagagatggaacactttcagttgaaaggagacatttaaaacagtcaaaagcaacttgcaaaacaaaattgttttcataaagggaaacacatatctgggcgttccattgctgaaaactagagattggaaacacaccagctgtggtaggcacacacccttctagggttagagagattgagctccacgtgggtgatggagctggaatgaagctctgtcactccaaaactgctgacgctggtcttaaactcgtttttactttcaaactcaagtgattatatgacttttttttaacctcttatttttcattatcatactgccatatagcttagcatattaaatggtaagcactgtggtctccctcccattaggctgtgatctcatctgtggcacagactacatcttatttattttgtacccccagtgcttagcagcgtctggtacttatatcagtaatgtttattacctcacatgggaatggataatcacagaagacttccagaacaaagtatattttgagcaactgattatccttttctatcactgttttccatatctaactttctccgcaaagagcagcatgatgcatggtaggtgcataataaatatctgcagttatttgattataaaatagcctccttctttaattgtataattttgggctttgctttgttgctatttatgtgaacctgcaccagaggaactatatttacacagatttgtcagtttttctaagctctgacaaaaagtgtgttttatttcctgaaaataagcctttgaaatattactatgcaccttgttgaaggtacttactgcacaactcagatgatgatagaatgattttaatggaaatcaagtagctctatacattgcatggatcctggtagagatctaaaatgcttccagacatttagatgtttactgagaatgcttctgaaaacattgtacctcaaaggccgtgtctacctaacaaaggtggaaggttaaacccctagcttatttttatccttttttcttttaaatcttgactgattctgtatcaatcaaaatcagtggataactactcacacagctcaattgtggtttgggtaaatcaagtctgagggggtcatttgacttacgcaaaatggaaaaaaaaagctgccatttttaaaaacgtgaagaagtcattttaattacacaaacacttttgtgtactggaaattggaatgactagtttctttcaggtgcacaagcagatgtcagagcttgctagaatatttagctagcacatgcgccataattctcaaggttctctgttctattttcaacagtgcccttcttgtgtttgaccaaagtggccccctttacttttaatatctactgagagcttataatttatcaatttatcatgtcatatcaatcatatattatatcaatctatctatcatctatctgtcatctaaagaagttaaaagtatctcatccctgaatgtgtcttataaatagtcataaaatttcacttaacacataaaaaaccatgaagatgtaagcacaaactaattaaactgtgaaccccagtgaaagtatttctatattcaatggccatcacaaataggcacatcctaggcagctgaaatctctattttgaacacagctttaaaaattttagtgaggtcagaggcccaatgtattactattttatagtaatttcaagatttctcactcaggtggtgaggcgatgtcatgtgtgacaaaccaagacaaatagtttctttgaagtctgggtcagaacggcatggttggttttttgaaaatttcataaaatgctatttagatgactttaaactcataagcagtaccaataagaaatattctcatggaaaaaatatataaatctagaacactttaattggtttttttaaccattgatttaagaatcaacatttacacagttgggtatatttttataaaatgccacaaagttaaataattatatatcagttaatgttctcagtttctaaagcaagtgaattgttccttttttgaaattgaagtcttttcaagaaagattaaaataagtatgcaatcctaaccggatgttactttaatcctcctgaaatattagtcaataaacatttttcatgcctgattgcttgttttggtgataagactttttcaaaatctccttggatccaaaggaacaacaaagggaactggagggcgtaaaacctgttacttctcactttaacctagacatttgcttttacttttttcagatttggtttgcaaacattttcttaacatgtcaggaaagctgaagtcatcttatagccctgatttcttcctgagtgaattatttttgggtcaattttccccatatctgcctctggactcttattgaaccgagccaagcttggaattcactttggatgtggatgaccagaagtttctaataatctgcctcttctttgagtcttctttttttccctacacccaaagtatctattgatgggactcatgagacagtattttctgtcctctcttttgttagatgattgtaccattttaaaagatctcactcccaaaaataggcttttttttttctacttttcttccaattataactctaatttttcttaatggatataggctactgagacataaaccaaatatagtgtctaggtgcacagttcctaaaggaagctgcagaatcgaaaaggcttatcatctttgactgccccgctgtcaggtgacgaactgcagaaagatggaggagactagttgttcaatttgttggagaagtaagttaattaagtcaaggtattttaccctcatcacttccctctgattaagtgtatccttttccttatacaacaaatgagaaaattgaggtttggagagaggagaggttaaacaaccttacctgtattacaaaagaactagcgaagcagggatttgaactcaggtccatgtcattttaaggcctgtttgtactcttgactgttgtgctacatcaacctgaccagctatttagaaacacttgcaataagtcataagaagtactttgttatgggaacaagtcaaagctcaaaggttgtgtgaatcatgggtcagtagtcctggttggcacattactgtacaataatgcccaaaatgacttcattggtcctaagagaaaagtattatctccatacccgaccaggtgagttaagctctgggaaacaaattcgtttaatcaaggcccacagaagttgacttataaaatgggatttcaaattacttctgtaaagaggattacaaatatagattatttgtggaaggttttcccttccacttgatggatacactttggaggtccattaatcaattagaaagtttctataatcagaacaaagaaacaatgttcttaatggatttccttttaaactgctgcaactgaattatggttatgggctgaattgtgtctcccccaaaattcaaaggttgaagtcctaccccctgtatctcagaatgtgactctatttgcagatagggcctttaaagaggtaattaaggtaaaatgaggtcataagagtgagaacctaattcagtaatactggtgtcttaataagaccagattaggaaacaaacatttgcgcacacagcggaaagaccatgtgaggacacagtaagaaggaggctatctgcaaaccaaggaaagaggcctcaaagagacaaccctgccaacaccttgatcttgggcttcaagcctccagaactgggagacagtaaatttctgttgtttaagctacttagtctgtggtgttttgttattgcagccctagcaaactaacacagtgattaatttttctttactgtataattatttctatttcagtaaacaatgttggccattgaaagtcagagtttacgctctctaaacagtactgaatatgtactgaataatttttaatctccttcctaaactccattacttacttgcctcttacattttcttcactaaataattagtttattttttagttaccttgattagatttggtaaaaactctaatgtgagtcatcattaaagcttctagctagccacattaaaaaataaaaagggacaggtggagttaatattaataatatgtgaatatacattaatatatgttatgtagtgtatccaaaatataattattttaacctgtagtcaatacaaaattattaatgagaatttcatatctttttttatactaagtcttcaaaatccagtgtttattttactcttagagcatatctcagtttggactggctacacttcaaatactcagtagtcaatgcagctagtggctactgtgctggatgtcacagctttagacttactgttgaggatttaagagacactttctccatcatgcaggagacatatttctcctgcagtgtatttgcaaatcttttttaaggtgagtagttctgcagatggttgttgtatgttggttattttaagttttaatttcagagtgtaataggctctgacctaagaggataatcttcatctgatttagtgccatcgtaggtacacattcctattgacaaagtgcaataaaagaaagttcttactaaagtttcaatcaggtaatattttactattgaggcttactgataatgttccattttctttttctttttttaattattattatactttaagttttagggtacatgtgcacaacatgcaggtttgttacatatgtatacctgtgccatgttggtgtgctgcacccattaactcgtcatttagctttaggtatgtctcctaatgctatcactcctcactccccccaccccacaacagtccccggtgtgtgatgttccccttcctgtgtccatgtgttctcattgttcaattcccacctatgagttagaacatgcggtgtttggttttttgtccttgcaatagttttctgagaatgatggtttccagtttcattcatgtccctacaaaggacatgaactcatcattttttatggctgcatagtattccatggtgtatatgtgccacattttcttaatccagtcaatcgttgttggacatttaggttggttccaagtctttgctattgtgaatagtgccactataaacatatgtgtgcatgtgcctttatagcagcatgatttataatcctttgggtatatacccagtaatgggatggctgggtcaaacggtatttctagttctagatccctgaggaattgccacaccaacttccacaatggttgaactagtttacattctcgcccacagtgtaaaagtgttcctatttctccacatcctctccagcacctgttgtttcctgactttttaatgattgccattctaactggtgtgagatggtatctcattgtggttttctttaatagatacttatgaaattacctgccatatgcaagctagtaagagggagaatatgtgcaaggcagtttctttgaagttgattatctgaaatattgaaaagttttaaatgatttaaagggaaaagcactaccatttgttgggttcttattatatacctgacatacgtgctgtcacttgtcctttaataatcctgcgagccttacacaaatgagaagactgcagctcaacgggtttgagtaaatttcccaagatcacactgttcgtaattgttgaagtctctcatcctaatttgtctaattttaaaggattttgtgatacagttaaatgttattccagtgcatgcttgatatttgaaatgtttcaaatacatacaagcaacacgaagtacataggaatttagcaaaaacttaagtgtaactcttaagagtgtgggttttggaggaggatggactcaagttcaagttccagcttttccacttactagttttttgaccttgggaaaaatttgcaaactccagaagcctgtttcctcatttagaaaatgggcatcataatagtctctatctcttagggttgcataaggactaagtgagctaattcaggaaaagcaccctgtgcgaggcagacactctaatgacttgccaaacgttagctacttgttcttttttttatcacaggcagtgacaggcctggtacatattaactatttcaatttacaggaattttcttgactacccaatatagcagaataattttttatacattaaatatgattaaccagagaagccagaagtacttttctgtaattaactatacaaactgtattagagaatcagaacggttttcagaagtagatctgatattcaccaacagctagaggagaggacagcactgatgtcttttctacctacaaactaatagctttatcctttaaaggtggtgaccttgatttctttctgaaagatatctgacttctaggcaacactgctttaggatctgacctaccacctgacccatttaaaatgagatagaagaataagttgttcagaagtcacacctaagccattcaaagttcttttcgtgcttttgctatggctaaagattgtattaagatactggcaacaaaaacaacgaaatgaaaatgaaacaatgaacagaataaaaatcgagaaagaaagttctaaaaaagagcttccgcccagggatcaagtgcttccattggtcagttagtcttaacctttctgataattatattacgtgcaacaacaaagacacaaaaggggataaatgtcttaagagttatattgataaactatgtgtggtgcccaaaaatggcatggaatatcttgtttaagctgtaaaaatatattagcatgtcatgttatcttcataaattcttctcacacatagggtgggtggagttcccaaatcccaagacacattaccaattcggctggtcacggcaattcatcaatttttttgtcacatattcgcagactcacagttgggactgaggtattatgattctggagggtttgataataggtgaattattagctgttggggacagatttgtttctgagcctttctgtggcagtctcttatataggaaggtaatcattctcatggaatttgcttcctcagacttaaagagatttcgaatataacttgtaatgtttttcccagtaaaatttcattagtggttaattatgactggtagagctttccggaagttcaccaagagtgttgagtttaaacatgtcaaattttaaatgggagagccctctgtattctttgtcaccatgcttacatacattctgctatttctttttagaaagcaaaaatacctgtaaaatttattttttcttaggctggacacaattttaccttttgttttctgagcatttatttggcactctctgattttgggtaagaaaaaatttattccaagggatatatataaaaaatatataaatttatacaaatataaatatttgtatatattatacatttatatattaaatattatacatttatatattaaatattatacatttatatattaaaattttctttgtgatttcttatttgacttgggtttcttagaagtatgttgcttaacttgcacgcatttgaagattttatacctatcttaaatttttttttaaattatttatttattttagagaagtcttggtgtgttgcctgggctgaactcaaacttgtgggctgaagcgatcctcccaccccaggctctcaagtagctggggctactggcaagagctaccacacctggccagccaaggaatatttaaacagcatctaactttgataaatatgcaagaagttaaatgctttttatggctgttacaaatcaggccaggcaaaaccaaaggtgtgctcaagtctggtcatcttatctagaagcttctgaaagaagccaggtcatatcaaaggcagataaaacaataaatttctcttccaaaagtgcacatttatgggaaacagaaagaagaggaaacacaaaagaacgcaataaactcaatatattttttctcagtatgtttcaagtgtctattttagaaagttatcttcctatttagataccaactttatttcacacattgtcatcaacttcaaaattatcttgataattaacattttataaattgcttgtatatttttcagtgaggtgggggaggatatgcaaataaaagaggttttccaaaaagtcaatacaatatatagttacgttggaataattgaacctacctgggaatataatgttgtcagacttctgtgctgctttactgcagactaggtttatctgaaaactgcagctaaaatttcctgactggaggataaaaaaggagaaaggacaaaatttaaagttggagaaatggtcaccttggccatggaactctggcagttacatctactgcaaacggtccaaaatactagagtcaacttcaaaccttgttaaagagttttacatgggtgagaggtatctctgtttcgataaagaattacatggctgaatgatctggaataaggtaatggcctaaatggtatttggttatatgcagtcaaggatttgtaattgaaatgaggtatgagtaagagatgatttctgttaagttatttcaagctcttctgtcagccctatcccatgccatcttagagaacccttggtttaggacagactcagtcctggattttcttatttaaagtgcactgcggaggatacaaaggaaatctaagtcataggctctatattctagaaatgtatacgctattttgggaaagcagcactcactcataggagaagatggaggggaacagcaatgagggcttgagctgctatgaaataatagaacttggataggcactgaacagggaggatgacaatctaggcatatgctggggtgaccaagctgaacaggagctagctgaggaattagacattctccctcttacctatttgtttaactcagccattcactcaacacatgtttattgggtatccaccatggatcaggtgccttgctacggatggtagtgcagaaggcaatgaacattgttgccctcatgaagtttaagatctagcaggcagcaggcaccaaatgtgaaaacaaacgtatgtatttaacaagaagctgcaataagtagtagaaaagaaaaacaagacgccatgagaaacactacaggtcgaggaaaacaggtctgaagaaaagacatttaagcagagactcaaaggatacacagattgagcatctcttatctgaaatgcttgggaccagagtgtttcagactttggatttttttttttgaattttggaatatttgcatatacataataaaatatcttgggaatgggaaccaagtctaaacatgaaattcacttatgtttcattttatacacataacctgaaagtaattttatataatgtttgtattcttttgtacatgaaacaaagttttgattgtattttgattgcaacccatcatacgaggtcaggtgtgaaattttctttttttttcgttttatttttattatgatactttaagttttaggatacatgtgcacaatgggcaggtttgttacatatgtatacatgtgccatgttggtgtgctgcacccattaactcgtcatttagcattaggtatatctcctaatgctatccctcccccctccctccaccccacaacagtccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaatacacatatgtgtgcatgtgtctttatagcagcatgatttataatcctttgggtatagtcaggtgtgaaattttctacttgaggtggacctcatggatctcactttgcttccttctgctctcctgctgggcttctactggctgaagccaactagaagtcaaaaggtgatgtattccacgcatgttggcctctcagtgtggagattagggtctgcaaggtggagcggtgatcttggggaaaagggaagatgtcccccacaaaaagtctacacaaaacacctattatgggtgaagcttagttgtagggtatgcaagagaattgttagccttgtgaaaagatttatgaagctttcttcagttttaaatccctctgtggtgtggtgtgagctattagaataaaaattactgctgcctggatactattaaatagacttttctcctgagatttctccggcttaggaattcagacttttcttcatgggcttcattttctcctctctgtctactatgatgctattgaaatcatgcatgtatggcagtgtcctggagagtgcaactggccagaaacttctcatacctgagcaaagtgctgtcagagtcactcaggcacctatgcacattcttatagtgacacgtttcctcctgacaattgctctgctctttcttagggtggctttgtaattttttttctcagcaaggccatgggtgttgaaataaaggaaggcagaaattgaaatgtgtcgataatacagtcatcccttggtacccaggggagattgattccaagaatccctcagataccaaactctgtggatgctcaagtcccttcccttttataagatggcacagtatttgcatagaacctgtgcaataaataggatttgcatagaacctgtgcaaatactaggccatcttatttatgagtttggtatctgaggggttcctggaatcaatcagattgattgattattcattctcccatgtactttagatcatctctagattacttgcaatacctaatacaacggaaatggtatgtaaatagttgttatattgtattgtttagggaataaagacaagaaaaaaaatctgtgcacgttcagtacaaacacaataatcagtatctccccgcccccaaccccccagaatctttgaactgtggttggttgaatctgtagttggctgaatccacagatgcagaacccatgcacatggagggccaattgtactagctgacatttgagcagtgggattcctgtgtcagacaaaggaataacggtatttaacaaatagccccaattcccctttccatcttagtttcagattctgcaggaaaaagacagctctgaaaatttatgagccataacttgctctccattactttgtcacccggtaagcaatgagcacccaagcctaggggtcacctgcaggactagaaacctttgtaatttcacagggggaagttcattggctgtgggaggagtgatgaggtgctgagaggccactcagtcaacagcaagcctgctgaatagttttattaataataagagtatacatgtgtacagagctctgtagttataaaattttccccaaatgtgagaatctcagttaattcttatggtagcgctgtgagtcaggcagggcaagaaggactaactcccatctcagatgagaaattgagcctcagaggcaaactgacctgccagcctcctatggctgggaaatgacagagctataggaaaccaattcctttttttttcttccttccttccttccttccttccttcctccctccttttcttttcttttcctttttttctttcttttcttttcaatcataaaaatttccaatgaaagatttcaaagcagagaacatctaggcctcttattgttctcagataatttgaggatgtaggggtaacactttctttcactgagttttgtttataagattgtcgaatgagagaagaactgtagcattggaaataaggtaatgctctgtttgaattgttgtttagatgccccttctcttgttttccccttttcagaatactggtagcagaactggaagctattcaaggacagcacaaatgcttactcatctttttatttgtatagatttaggggtacacgtgcagttttgttacatggatatattgcatagtgataatatttgtacttttattgagagaggagttatataatctgacttgcagtcttcaaaaggctcctttaggctgggcacagtggctcacgcctgtaatcccaacattttgggaggctgagacaaaagtatctcttgagaccagggttttgagaccagtgtgggcaacaaagcaagatgctgtctctaaaaaaaattaaaaaattagccaggcatggggcagcatgcctgtgcccagctacttggaaagctgaggtaggaggatgacgtgagcccaggaattcaaggttacagtgagctacaactgcatccctgcacttgtaggactgagcgaggccctgtctgtaaaaaattttttaaaaaggatcctttggtcattatgttaagcacagatactgaactcggatggaagcagaaaagtgcaactaaaaggctcttgcaacaatctaagtgagagatgatgatgttggctggatggcttggacagaaatggtagcagaggaggggataaggagtattaagacttggatatagtttgaaagcacagccaatggaatttcctgacagtttcaatgtgagttgtaagaacaagagaggaggcaaggatgaatataagtgttttggcccaagccactgcaagggaggaggcttgatcaatgattatggggggaggatggaggtgaaacaaatttaaaggaaagacagagttcaattttggaaatgttgagcttaaggtgctgcacatttgtatcagttgattttttcttctgtacaacaaattaacagaaatgtagtggcttaaaacaacattcacttatgaactcagttttttaggtcagaagccaggcagtgcacagctggattctctgctcagggtttcataaagctgaaatcaagatgctgcaggctgagttcttgtctggaggccttagggaatgatccatttctgggctcatccaagttgttgggagaatagagtttcttttggttgtaggactgaggtctctgttttcttgctggctgtcagggtgggagctgctctcagcaatggaggtcactttgggttcttgctccatgacgccctccatcttcaccagtggaaaatttccctcctgttgaattcctctcctgctttaactctctgattttcttttccgaggtcagtggaagaaaactcaatttttaaagggctcatgtgattagactaggcccacatgaatatcttcatttcttaaatacaatgaaacataacaactacgggagtgagacccatcatatttacaatcttagggatttcccagagccagaaaccttgcgggaccatcttggaatgctgactaccacagcatccaagtaaggatgtcgaatagacaattggatattcacatttagagttcaggagagagagaaagcttgagagtattggggtatagatggatttaaaacagtaagactgagctcactaagaatcaatgtagatggaaaaaagaagttcagggactgaacttcagggagtgtcagcattaagagatcagggaaaagaggaagccaagtttcacacacagacacacacacacatgcacacacacacacacgaatatcaaatgttatcagtttgatcaattgtgtcaaactgattaattcaacccattaattctgctgatggatcaagtaacataaggacaaaaatttgatttttagatttagcaacatggaggactttgatgacctttatgagaatggttttttatggagaggagagagttagttgtcagagtgccatgagggagaatgcaaggaagctaattggaaccagtgactttagcctattgctttagagggtttgccgtgaagggcacagggtgatgataatagcttggggaaggggaagtggggtcaaagatgggatgaaaggtggggttaaagatgggataactaacatgtttgtatgttgaagggcgtggttagttagagaggaaaaaatggtgatgaagcagagagaggtgagaattgccactgtggcatatagaaggtgaatgagcaaggatcaagtgaacaaatggatggatcagctctggatagaaagaaggatgtagtgcccatttacagcaatgggtgggaagacatagtatttgggtacagattgggtcacggcctacagatatgtagtttgtgttctgctcagggttttctgcctgagggaagagtggaagctgaaattcagtaaagctgtgtgttcttcgtgtggggctgaatctacccagtggaagggacatagatgtatcctttggggttacagatgctcctaggcggtgttgtgggctgaatcgtgttcccctccttcaaattcctattttaaagtcttcactcctaatatctcagaactgtatttggaggactttaaagaagcaattaaggtaaaatgaggtcataagtgtgaggcccttattcaatgtgacggatatccttataagacgaggagaaaacagacaccagagatgcaggcatacagtgacaagatgtccatctgtatgccagggagacaggcctcagaagaaacagcccttccaacaccttgatctcggacttgtaacctgtagaactgtgaaagaataaatttctgttgtttaagccacccagtctgtggtgctttgctatggcagcccgagcaaactaatataggagggtagatgtgataatggaagtccatgagagttctttcggattatttccactttctcagatataatctttaaaatgcaaccatggagatgttgttgctacaacatctctgctcagaacttgactcactcccttggcaaaagtgctgtgatctgccaatattgtgttgattcttacttggtaaataatgtcaaatagcatcaaaagctcaatatgaagatatggcatataaggtatgaatgctttgtaattgtattctgtcctgaatcccactaaagcatagcctattgaactgtgagtactatattaattcttcagctttactatgttgaagtctaagtaaatgagaataccatttaaaccacttaatattcaagtacacattaaatctgagacagtgagtgtgtctaaaagtatcttcaatgacttatcttagtcataaaaatcatgtgttttattgatatggttacactattaagatattctagcacctttcctgtatctgtaatacattaaaggcttttcttctgaaagtctttaagttttctaaataggtataatttacaaatatttatactcacttttgattaaattactttaagcaaaaataaagcatgttaacacatgagtagaggtgagagttataacaattaacttctaatttttatttaataattctaaatttctgattataagaacctcaacattgccaggaatattatatatttaaattggaaaaacatcactagaacaaatacatttttaagaaaattcaatgccgtcacaggctggctccttccttcccacttgtgatgttctcctctgtaacttctcccctttaactgtattagacaggattctccggagaaacagaagcaataggatatatgcagacatatagaaaaatatttattatgacacgttggctcacacaattatagatgccaagaagtctcagagtagctgtcagcaagcccaacaaagccagtggtgtagttctagcccaagcctgaagacctgaaaaccagcagttccaatgtctgagggtaggagaagacagttgttccagctcaagcagacacagtgaattcatccttcctctgcctttctgttctatctgggccctcaatggattggacgttgccgcccgtattgatgagggcagatcttctttactcagtcaacagattcaaacacgacatttttcaagaaacactctcacaaacacacccagaaataatgtttcaccaggtatctgtatcatcttaagtgtgcttaagttgatacagaattagctatcatatcacctatcccaaactcccaagttctttaagatccttctcaaatcccactgctcaataaagctgacccgagaactccagcctgcatcaaactctgcttcctaagcagacacacacctattagctgtatcattaatttacacacaattgtttagaactgattacatgcagcttcacacagtactacatatagttatttaatttttagcgcatgcaattatctctcccattagtttctgagatgtctaaaggcaggcaggtcacactttctgttctgagggcacattagctatatattttgttgaacaaattattattttttcatttattcaaccaccacttacttggtactcactataagccagggactgtgctaagttcttggcatgcaaggattcttctgttatttattaattcaatccatttgtatgtaccaggtgcctgagatacaggcataaagtaaatcaaatctctggtttcatgggccttacattttagtagggggacagataataaagaaatgcagacatatattttatcaagtaatgataagggctgtgaagaaaatgaaacaaagtgatagagggtggaaaaatgggagggtgaggatgttttaaagaagatggtcaggaaaggtctctgaggagatggcattggagtggagacccaagtgaagtgagagagagagagacaagcaaatccctgaggggacaaagtttctggcagagggaacggcaagtgcctgagacgagagtgccctcggcatgtcccaggcgtagcaggttggcgaactgcagctagaaggccttgagtgacagggagagctccctggaatcaaggtcagagagagaggcagaaccagtccacagcagactttaaagggtttaactttatgcgtgatgggaagacattggggggttcagagtaggggactgatgtggtataatgtgtgatacgtgagaccagtgaaaaagaccctgtagctgcacaaaagagacttcaaatttattatcgaaagttctactacacaaacattcatagacatttatataaaactatgaaattgtaaaaaaggaatctaccagaaataaaaataatctgctctgtgtatggtctgtacagagtgcatatataggtgggtaattgtaggaaatggaaaatagcaaattaaaatggaagattatagcctcaaaagttacaaagataagaaatatagcatttaggaactgaacactcaaatcaaagaaatgcaatttatttatctgagaaataaaaggtgtggctaaattgagattttgcttttatattttaatgtctcaaggtataaagatatgatttaaacactctctttaggaatataaattactgttaattgaattgtaggtcccgaacaatgtttagtgaatatttacagtgaacattttcctcacactggggcatagtgactatctggtaagttggcttgaagagctgtgaggtagacacaatatggtcttaaggtattaactaatccaagctcctttttctgttcacagatgacctcttaatgctgtacataagagatttgggttgtaatattaattttgttgttagtgtgataggtgacttgtagcaagacaaaataaggaaggtcatcgctaatgtctattgagtgcttaccctgtgccagcgactatgtgagctctgtgccttacattgctgttttaagggcttcactaatggctttctttaccagaattctttttgttatttatttttattgtcaaattataattatacatattcttatgaggtacaaagtgatgtaatgatatatgtatacagtgtggaatgacggaatcaaacaattaacatacccagcacctgaaatacttatcatttgtttctcctgtctaaatgcaattttgtaccctttgacccacatctccccattcttcccaggctcccaggctctagtaacttccattctactctttgcttctataaatttgattgtctcatgtaagtgaaaacatgggctatttgtctttctgtgcctggcttatgtcacttagcataacgtcctccaggttcgtccatgttgttgcaaatgacaggatttccttctttcttaaggctgaatagcatcctattgtgtagatataccacattttctttatccattcttccattgatgggcacttagatggatagcataacttgttgttgccagagttctgaaccaaatgagagggattctcggtcagatggggaatcaacatgtcacttttatgatgaatgaagctaatatcagacaatgtggcaacaacaggcttccaaatgctgaatcctggtattacacagatttctgcatgtagtctcaggccatgctggtcaaaagtgggattttccatatgaaggatgatctaagaggagcaggaaagggcagattctgtgggcagccgctcttaggagagagggagagaatggagctgggctataggaccctgcttcatctttcagagtcactagtcagggatatttaaggccactgaatggggaaaaacccttttccatggtaatggttatatatgctcatttattagtaattctcacagcaactctataaagttggtcttatacaattttacagacacagaaacagaggcacagagaagtgccacagacaacttgcccaagtcccccagtgaggatgtggtggaaacagcctttgcatccagtcagtctggtctggcccctaagttcacattcgcacccactgtaccctcctgcttctccagtcttttaaagctgagatttgttatctgagaaaatgaaggggttagattagaaaaatctctaaagttcctttcaactttaaaatactttaatatgctattaggtttcttgtaaaaatatttgggtgtgtgaagtattttaaagtcctcagggaaaggataatgtggaacaatattatatacaacttaaaatgctattttgatgagaagtcatagtaggtaattgtaacccaattctgttttcaatgtggaaaacttaacagcttaaaaaggaacagacagatggaattttgctaatgtgtccaagaaggaaatatgatttcacatgcatattatatgcaagtttatgaatgcagttatagtgtctggaacctggctaggaaactatgatgaaaatcagtgaagtaaaatatcaaaataaaacattgcatgacaacttctaacggggagcaatggtgggacttttaataaaaccacttggggatattaatgtgatacgtaagtggctgaagggttctgagtttccctggtgatattcatatatcacagagtgaatgttaacgggcaataactcaagaaatggcatgtttagcataccagtggagagatgctggagttgtgatcaccaatggtacattataacattttactttgagtcagaagtgagtagaccctagcttataatttcctaacaacttgtttggagcaaagttttgggattataatctcaattaaggatggaatgtatgtcttaggtaacaaattcacctttgtctatgtgaaagggtagggacattaccaacatatttccaatgaaacagcttttggtgcattcatggtagcagagaatttactccacatttaaatacactctgggtaattaggaattgtacttttagcaggagattaaaaaaaactcttaacattttaaaaatggctttaatagtagttctgattatgcaattaattgttcaaataacttcaatttttatgttaaaatcatttggtagttggtaagtgtaaaagacctttattccatgcaatacatttaaattctagaaaatgagctttcctctcatcttccaccaaaacgactcaaaagaatggcactgcctttactaattaaaacatatatttgataagtatgacttttttctttctaatatttcctttattcaggggttaaatataaattcttggcttgtatccgccatcctcttgagtagcactattttccagaattattctgctggcatctgaggggttcattctgaagtagtttttttttttttttacctgtagttaaacaaagattttatttgcctactggaacattatgtatacttgctcatcccaaaaggagtgtgtgaatgtgtttaaaactataagctgaaattatttcttaaaaaattatggtatgaaggggatactatgattcttgatttctataaaaagaattatttcttagatatacaattaatctctatatactataatttgcttctaatgataggtttattttattgattactatctcaggatagaggagatgaagtcttaaggagcagagttggtgtattcaaaaggtaaatgacacttgccaacttgccaacctggagcaaagtgacttaataaaataaacagaaaagcaccaggattctttctttattgcagtattacaagtgtaataatgtctctaaacatgtagaataaagtaaactgatgctaccttatttgactcctaataaattatgttgataacttgttaaaaacaaatgattagcaagtagtatgaatgtataaatgagctgagatgtattaaaaaactactaacatccagggtgtaatgactacagagaagacaagaaaggggatggctgagcagtgaaacttcatttgctacttattttgagaacagtgacctggacctcttgtgaaatattctcttgtgatttctccacctataaataacttgctttgggtctgatggcttctaatcagtgaataatgattgtcaaccgggcctcagttatcaacagcaaccacggaagcatttatggggcatttaatcctcataacaacccagtgaagtcaggaatataattatcttcattttacccacgaacaaactaatacacaatttaggccatttgcaaaaagatcatcaaataatgcaaatgtaacaaaatatttattttacccctgctatgttttaggcattgtgctggtcctgaggatgaaacagaagacagtctgtactctcaattcctgtatagtcagccttctgagagaaacagatgacttcccggtcattacaatatagaggcaaagagctaatgcttgcagttctgccttggtttgctgcaagatatagaacacatttatagggtctgagggaagaattcagctgacagtagcagaggaggctaaaagtgttctctttcttgtgtgtgcttgctagtgaaaatagtccaagtttatcttttttgtgttgttgttttttgagacagagtctcgctgtgtcacctaggctggagtgcagtggtgcgatctcatgctcactgcaacctccgcctcccaggttcaatcaattcccctgcctcaacctcctgattagctgggattacaagtgcacgccaccacacccagctaatttctgtatttttagtagagatgaggtttcaccgtgttggtcaggctggtctcgaactcctgacctcaagtgatccacccacttcagcctccgaaagtgctgggattacaggcttgagccaccgcacccgggctgttcatctttattctgctagatccacaaggctttagttctttgtaaccatatcatagcttaccactgtaccacatgagaagctactcctctcttttgcacatgtaatgccagaacctagatcttacgtttatttccagggctgtgtttaggagggtacttatctattgggccaaagaaaatatacacttgagaaaaacactgaataattttcgagatacatggaatttaaagctggctgtttataagatcaagttactatttataaactctcaattttaatatcagatgttttagctgctgaagaatgttttatttgtcattttgaatgttttaacatttagaagctcaccattacatgtattttccagacacagggaacaattacatagatttatagcatcagcagagccagttgtagatctgactagatttagaaatgaaatgtataacacactcggtccgtcattgaaactctaaatagtgggagtagagcaccaggatatcgtctgctctgcttctgttttctaggaactgcctctcccctctaaattcacacagttgtcataggtgccaccatgtttctaaatgtgacagttgattggttcagggtgggaggaagatccaagctaggctaattgcattatctcactatttttttctcattgagtaggcttggttagtcagagtttattctatttcagtcccagttgggtgaagtgcaattcaattctggcattaattacctgaaattagcaagcatcagactccccatcctttgcaaaatagctgtcacttcaggcaacagttgcaagtgggattcccaggccactcacatttctgactcaccagctacatacttggaggcttttataagttcaataatttgctagaacaactcatagaactcaaagtgtgatgcttacaatcacagtcttcttataaaggataccacccaggaatagccaaatgaaaggtcacacagggcaaggtctggagggttccaggagtggatcttccatgctctctccttacagagtcagggtgccccaccttcccagcacatcaatatgtccatccaccaggacattcctctgagcctcagtgtccagtctttgttgggatcttattacataggcatgattgatgaactcattggccatgtcattgcagtcaatctgtagcacccatcccttccctacaggttcagcgatggaaaattccacccctcttgtcatatccttggtccttctggtgagcagcctccatcctgaagctagctagggacctataatgactcacttcatgagcataatgaagactcatattattcaggaaattccaagggtttttgaagctctgtaccaggacctgggggcaaagatccaatatattccttgaaagtagagtctatcgtcggaaattctggtattagaactgagtgaaaaaaaatcagtttctttagcttccaactttagactcctatatggtgaaaggtaagacttagggctgttggctgctatttttcaccagaaaaatagaatccaatgtgtaaggagaaaaagagaaatgaagcagatgaagacaggagaagttatgaatgaaggagagagtaagcgcttagagatttgagtcccttttccaacttcttcctgtcctcggcttctttgagattccacattatccttactaaatatcctttgcttctcatttcgtccaactccagctgaatttcttaaaactcctaactgggctttctacttgatagagtgagcaagttaatgcttgtatgggaattgaagtgttatgtatacttaaataactttaaactccaggcaggacttattcccatttattacaaataagatcgaaggtcattggctgctttgtacacatgataatcttgttaactcttcaaagtgagcttctttgggaatcattctccacctattgtcatgtttttacttctgcactctgactatggtctctggcagtaaaaatatctttttgtttataatgttctaccgtagcagctgcaacagagaaccagcaatgcaactcaagattttgctcttgctgacccaagatctgttttgtgtgcagctgcaaaatttgtgttgatggctagagatctgcttccttctgtcagcccttagttgctttgaatgttatatgttcctttggggaccgactatgttttgaatgtttttgtcccttccaaaattcatatagaaacttaattctcagtacaacagtattgggaaatgtgactttggggaggtgattgagtcctgagggctctatcctcatgaatggaattaggtgtcctaatcaaagggcttgagggaattcatccctttttctctttttccttatgtcatcagacagaagcattctgtcattaacacagcattccaacgggtgccatcatggaagcagggactgacctcatcagacggtcaacctaccagcaccttcatctggaacttcccagtctccagaactgtgaaaaatacatttctgttctttgtaaacttcccagtctatgacggttgttatagcagcaaacatggactaagacagagactcataattgtggtttgggaacctcaattttggaaaaagattcaaggtcttggtaatgctaggtaatagctgactctgagctttgcatatttttgtaaaaggtcattgagtgtatttattatcagtgtatggaacatatttgccctacatcgtaactttccgtgagctggtctttctgcctgcaatgctattccctgagatagcggcatggcttgtttccttactattaatactttcaggcttcttctcaagtgtaatcatcttagtaatcctcgctgactaccctgtctaatcagccccctccacttattctctgtccctttatcctgatttattttttagcatttaacatctgacatattgaacatttatttgttcactttttaattgtttctctgctctattagaatgtaaattgtatgaaagagggacactgtcgattttgtaaattgtttcatcccagcgtctagaaaagtaacggatactttgtaggaactagcaaaaatttcttgaataaaaagagaaatggagaaacgcctctgctgctcagcactttcttaatactcctgcatgtgggggaacttcttgccttgtgaaacttatttctccaagaaggcaagtcagatatttgatttccaatctgcccttacagcctgggcaccgatcagatgcacccacacgatactctgattcagaagctgcaatctctacaaagcataggtcaggaggaatccgtgtgtgtgtgtgtgtgtgtgtgtgtgtgtgtgtgacagtaatagtggtagatgttctagtagccactgcctagtgtcagtggtgtgagctgcagtgtctgtgtctggtggtataagcagtggcttttctatggcatcattctacatggctttgagagttgtgcttagctgtatagcctccagattttactctcttcccttctcagtgagtttatgagttatgtaagtcacttaaaaaaaataaattctggctgggggtggtggctcatgcctgtaatcctagcactttgagagaccaagattggaggattgcttgaggccaggggtttgagaccagtctgggcaacaaagcgagacccccatctttaccaaaaaataaaaataaaaataaacattagctgggtgtggtagcgtgtctctgtagttccaactgctcaggaggctgaggagggaggacatcttgagcccaggaggttgaggctgcagtgagctatgattgcaccactgcactccagcctaggtgacagaatgagactctgtctctaaaaaataaaaataaaaatgaatgaaaataagctccttttctacttaaactagcttaaatgagttctgctgtcagcaactgagaatcttactgactcatagctgatttgaatctggacagcatatccagaagtctatacttttacaaatcaacttagtagtttataagctagaacattgttttgggggattttagtgttcatctagtcaagtaactttctatcattatttttatattagttatttcttccaataacattttacaagaaagagggcacccaatatttaaaattgaagttggtctgattgaagggtggtaggtgtcagaatcctcaaactctcttccctcacagtacctcaggcccctcattagagtccttaaagaatatagaacatgtgaattcattgacaatttaaccacctaattttccagcagagaaaatggatacatagaaaagtataaaaggcacataattagcgagagatcagtagctagaatgcaggtatctctacattagtccagagtttttgcagtactcttcactctagcctgaaaataaaaaaaaagtaataatcttttaaagttttcttctgggcatagtttgagtagcaaaagcaagagcgtattcaaatttaggctttaaaagttttaacaaattcaattagaaacgtatttccctactgtacttgggagtacttaaaaattgactttatgtgacttttaatttaaaaagacataatccaagaaacatttttcttgggataaaatcttatttaaatatttctcaccagcacatggtaatctaagtactataaattatacttttaaaattcaaatacatttaaaaaacaaatcaaattaaattatgagatagcactacacacctatcggaatggctaaaatccagaacactggcaacaccaagtgcttacgaagatgacgatccacaggaactctcgttcatggctgttaggaatgcaaaatggtacagcctctttggaagacaggtaggcagtttcttataaaactaaacacgcttactaaactaagagtcatgaatgtgctcattgctatttacccaaattaattaaaaatgtatgtccacacagaaacctgtacatggatgtgtgtagtagctttatttataattgcccaaacttggaagcaatcaagatgccttcagtaggtgaatggtgagggacattgctaatagggaagtctgtgcatgtgttgggttaggggttatatgggaaatctctgtaccttcctctcagttttgctctgaatcaaaaactactttaaaaaagtcttaaaactaataacagtgaaaaacacccaaactctgccaaaataatattaacccttatgttaagttcatgtgatatatttatccttttgaaagtctcatcaaatcaaatcaatgaaacagatattttctatggcaatgaggacgtaataaaataatctattcaattagtgaaatgagtcccttcatttataaggcaaattcaattacgtaatatgtagaggatccatttgaatttgacctaaattttctaaacctaaaagaataaactatggcatgggaaatatgattaacttccaaattgtctcaatcacaatttgagacaatttgcaatttttgtgctgtgattgatgacctgtctcagggtgaactattgagaaaccaagagtcaccaagaggcaacatctttgattctctcttttgtttctctttggcaaatgatgataatttgttcctggtgatttggaagcctctttttaaatgccttagcacccaaaaagctgtaatttcctattacattgctgtctaggctagtaccacaaagcaactcttttctaatatttttttcttatgattcttctcataagcatttaatttttttaaagccatgtcttatttgagattcctttttttttaacttttattttaagttcaggggtacttgtggagatttgttatataggtaaactcgtgtcatgggggtttgttgtacagattatttcatcgtctagattacttgagaatctttaaactattttttgttattgctaagtgagtagaagaatttaccttcaaatgaatttatatttttatatttttcttagttccaaaaaagaagtgaggaattcctcagtgatataggacaattttataactgatgcatcatcgactttcttgttagtgataagagagtcatgtaagtgaaaaaatagtctcagtgcatgtcgttcaaactgtgtctggtgctcatggttcaatacaccacccatgacacctctactatcctcacagccccctccataggcactagcgctgctaccattggcaccactgtggcggtcggcactggatatgtagaatcctcaatgcatcaaagcttggatatgctccacaacttcaagctgtattcaggattctccttctcctctgaagacgggggttttttattagacctgaaacggaattactgacaggaagaaatctttcctggaagtttttaaatccctcatataaaaagactaataattcttggattaataattttgacatctaagaccaaatgaccaaataccatgtaaaccaaaaagtgtcttaggcagatctcaatggatttagagttttatttccaaggtcgaaggcatgcccaggaaaaagaaacacaagttaaagtaggatctttcccaacagtgctgaatgtctgtcttttagattttcctcattgctatgaactgaattatgtccctccaaattcatatgttgaacccctgatcctcaagtgactgtacttggagatagggacagtaagaatgcaattaagcttaaatgaggtcattaggtgtattagtctgttttcacactgctataaaaaaaaacctgagattcagtaatttataaaggaaagaggtttaattaactcacagttctgcatggctggggaggcctcaggaaagctaaaatcatggcgaaaggtgaaagagaagcaagtacctacttcacaaggcagcagaaaagagagagcgcgaaggggacagaaccccttataaaaccatcagatctcatgagaactcactcactatcatgagaatagcgtgaaggtaaccaccccccattatcaaatcacctcccgccagatccctccctcaacacctggggattacaatttgagatgagatttgggtggggacacaaagcgaaaccatatcataaggatgggaccctgatccaataggaattgtgtctctataaaaagagacacctgaacacgctctttcttgcccctctctctcaccctctttctctgacactcagagtaaaggccgcatgagaagatggcagtctgcagggtggaagaaaaccctcaccagaaaccaaactctcagagaccttgacttcagacttccatcctctagaactgtgagaaatagatttctgttatttaagccacccagctgtggtattttgttatggcagcctaagcggactaatacatttgcgttccaattcttggacctggaggcagtcataaattagtgaggaatgaccaagaattgtacacaatatctgaataacattttgcaatgttacattattcatattactttaaaatttatgtatatgcatgtctagacaaaacgtgaaacatgacattgattctttacattggcagctagatggaaatgtaacatttgattgtgaatggttttattttcataaaaatatttcatatgatgtagttatattttcaaacataaaattaaactttatatatttggattttaattttgatattgattataatttttatcttttaactttaatatatatttttgaatattttagaggaaaattaacaaatgaaaaatattttcaagttggttacagttagaatttttttacacttgacaaacaattgtttttaatgcattagatcagagatcagcaaactgttgcctgtgggtcaaatcaggtctattgttcatttttataaagttttatcagaatgcctccacgctcaaatttttatatgttgtctatggctattttcactccacaacatcagagttgagtaattgctatcgacactatataacccacaaatctaaagataattactggccttttacagataaagtttgtggacccctgatttatataacagagaacgtgttcacttggaaatcatgatataaatataaaataccaaagtggatcttaaaagcaaaaaagcaaaaacatttaaaactaatgcttcaaatttaaatacctggaagctgaaaagtgagcagacttttgtagagcgtgacctatataaaatttgcaagcaggacattacaaactctttatttaaagaagatttaatgaaaatgagcaaaaatattattcttatgaaattcacaactagaactggcttagatgcaaccctgcaatgtcaaattcttcattaaatgaaggtgtaaccactggccaaaacaatgagaatgcaagagatagttaatcctaacaaagtcatacttcagagatggtaaatatacctttggccagctcattagaaattgaagaaaactacattcataaaatctgaaaactggataagaaagtcagaacccctggaactttactctgtttattggatgatgattctggaaaaacggctgtcatatcctgacatgagtgagactgtttctagcaaagcaaaatctgattcaaatcaatgaataaatttttccattagataaacatggcagcacatttatatttcattttcaacccaaattctttcaaattgggaaagaagttattctattctaagttcaaaggcaaagtatcttgtcactactgttatgcatttctcaaccaatgttcatgattggttttggcgaatgaagatacttgtcactggaaacacattgttaattaaaagaatgtgaaatgttacatgcatataacattagcaaatattagaactgaaaattaaaagactgagtaaatgacaaacaattgatttttttggcaaagaagtaaatatagaacaaaatacaaaatactgttataatgttcttaaaataatattgaaagataatatgtgtataatatttggaaaaacacacaatgaggcttattgtagcattaatatttattttaaaaaataaaagctttttagattcagtagagataatttccaatttgttaatagaatggctgaaaatgtagttatgaattaaaaataatgaaaaatacgacttctatctgggatggagaattcaaattagatcattaacttattggataagaaagtgggggaaaaacatataaaaagtaaatatttcaaaagtcacactgagacattcttcaaataaaaagcaaattgtggtttttattagaaaatgaattatgaatttaattatgaatatgtactatccatgttgcttgctcataataatattaacaaaagataatgaccatctccactccaaatgtgtgtggctacttcattttcaaaaggattaaaataaataactaaataactaaataaatacctttagaaaaaatgctttttctaaattgcaagaaactgcacgtgatatatgcaacattccattgaaatacatggaaattacaaggagaaatgaaaatgtttcattggctctacaggaaaagattcatgtacaaatagtctccaaactaaatttaatagactattttttttggccattagaacgcaggttatcatttcaactgaagagagattaggacaaattgaacaatactgctgttttcagttctctttataaacacccagatatacacaataaaagttaaattcagttttctttgctattttgtcaactttcagttatctataaactgtagctttacatatatttttcaattttgaaaaaaagttaattattttgaggacataataagtgtttatattcattaggtacatgtgatgttctgatacaggcatgcaattataataatcacatcaggttaattaggtctccatcacctcaaggatttatcatttctttgtcttagaaacatttcaattagaacatattaaatatcttttattattattattattattactattttgagaaaaagtctcactttcactcaggctggagtgcagtggctcaatctcagctcatgcaacctctgcctcctgagttcaagtgattcttttgcctcagcctcatgagtagctgggattgcaggcatgcgccaccgccacgcccggctaatttttgtatttttagtagagatggggtttcactatgttggccaggctgctctcaaactcctgacctcaggtgagcctcacatctcagcctcccaaagtgctgggattacaggcgtgagccactgagcccagccaaatatttttaaaaacaggttgttagcttgtgtaaaatataaatatctagacacctgtgcttccatttggagtcttgctcccagcctctcggtgtcggggctggcctcaccttcctcatgggttatcatgagggacatcagatgggagaaaatgtgaaagcacattgactatagatgaggtgactttctgttagccttctctctactactgctacattttaaagaggtctttggttgctgtttttaggaagtggggctattgcttcacactccaactgtttagtattttctttttaatttgatgccttcagttttccaatctgaaaaagatgctttggtttgaataaaccaatgtaagtaggcttctcctgttgaaaattcaaagaaatttgcttttgggtttttttattctgcattcttcccgggagaaatgtcttcccatctagaagaatcagcagtcttttactatccagacctattaaattgaacgattgattgtaacaaagcctacgctgttatattcaagcagttgttacatatctcatatgccaaaattgttaaaaataacaaaggcctattatctcgaatgtgggaaaccaaatcatttttttaaaggcgtgattaattgtgtgagtttgaaccccttaagtaggtgtggtaagctgtattccgtgggaacttgctcagtatgtgtgcaactatgtaaacaaaaagttaaaatgcagctaacactttccctggcatttattagcatagcaaagaaagcagaaaccaaccaatttttacataaaaagacagtagaaagctgtgtctgcctgcattactgttcaatctgtgggtgccaactatactcatagaaacaatttttatttataggcctatcaccaaaatgtgttcttcattaattcatatttttctcagcctcacattacttcttgaacccatccaggtggtttttaaatgataagggtaatttaaaactgagcaaattcatgtgtaccccattttccgtgtttaagaataattgaacggaaacatctttaccattcattcaatattttgttaatttgtttacctttagtgaacctgaggaataccacaaatgtgagcatggctggatcttttgaattaaaatccacactgggaaagaaatagaccttgaacatcttgccaaaggtatttagaaatctatttctcacaagattaaagctgaaagtccaaagtaactgcagtttataccaacaatacagttcagtgaaatgctgttatatcaaacatttcctcatatatgacactcattaaaatagaaaaggcctcatctgaaggcttgtaaagtgacatttcttccatataatattttcctgcatgtaatgttcaaaaattgtggtgccttggaaaacattacaaaggcttttccttgtagatctgtacttgttgttaaatttcttttgggttgtccttctggtgggtgtttcatagccttttatagattcagtctatatataataggaaaaaagcccccttcatttgattttaaatagtatccataggaagcagcaggagaaagtttgcattcctgggtgaaggtccttgaacacatttttttttttttttttttgagatggagtttcactcctgttgcccaggctggagtgaagtggcacgatcttggctcaccgcaacctccgcctcccgagttcaagcgtttctcctgcctcagcctccggagtagctggattacaggcatgtgccaacatgcccagctaattttgtatttttagtagagatggggctttgtcatgttggtcaggctggtctcaaactcttgacctcaggtgatccacctgactgggcctcccaaactgttgggattacaggcatgagccaccgcagctggctgagcccatattttgttccaataaaggttcagtcatgcccttccattttttgtccagtgaagtgtgtcacccatgctgttctctgcaactaatggaaggagaaattgttgtttgtagattaaagtgacccgctcaatctagagagtaactttacctattttttttaatactgcattatacaggcaaagcctccatttaaagaaaggtaactgatttgtattgcaatagtgtaacttaccaatacccattattcaacagcctagcaaatgatgattagatgattaaggcagttttctacttcaccacaaggctgttaagttcctagtaacagttttctagcgtgcagtgtataggttatatacaatgaagttcatgcagacataatctaccttctacttctgcatattatgtatgttttaagcaaatgttaatccaaaagtgccttcttattcactcaatcatttattgaaaaaatttttggagcacctactatgtgccaccaggtgtaagagttgacaccatcctcatctttccaaatttgcagacatggtacaagggcttacgatagattgtgttgaaagttgacatcagtgaaggcacaagatgttacggggaaaaagagcaaagtgatctgacctactttatggagccaggaaaggcattagagggtagacgtggtgggtggcgtttaatctgaaacctgaaggatgagagggacaagttaagggaatgtgtatgttgcaaattgagaagattctcagacagagggaagagcacttgcaaagtctcagaggtcagagagaatgtggtgtgttcaaggaaccagcaatttgaggccaaatttgaggtggagaaaaagagagagcatgatgacaggctgcatgtttcaggctaagcaaattatttttattgttagctaaggtaaaccataataaaaagttctgctaagtaaattatggaataaatttcaaattttctctcacactacacattcagggttcattgcacaggcaaccttgccaggcctgaaattcaaatctgcccctggcaaggagagatttcttttcacggtttttaattgatcatctgggtgccaagaggattttgccccagctgaagggttgtacaattgagtctaagttggggtttggggcatggacacgcatttggaaatggaaaactttcccataggataacagctctaagtctgcggccgtgtgcttgtgctcccctccaggcagggaggacatgcactgctcagggttccgagctgacccaagcctcttacctcaaccccctcctcctggtgagagagccccactgggttccgcagagaagaggaagaggatgtgactcaaagattctgggcttccttggttccctgggctggaagtcagagagataatggaatccaggtgtgtgatctgcatgcatgcaggtttattttttttctctttttctttccaaagcagagaaggtgaggggtcatttctactctgggagagagcccccgaggtgtcagctgtggcggagtgctggcggcatctacagtgggggtgtcactcagggtggtggtattagagatagtggcagaaaaatctggcaaggctccctggggatggctgctgtggacgccagcccagtgcggagaggccagtgtgatctcacccatcatgacctcaaggtccttctttgagggatcttgccaggaagttcagttggcaggatggcagcagcagacacacagggtggttaagaacaacaaacacaggtaacatctgctgaaggcttctacaagctgagcactaacaggtactaacttaatccttgcactcactctaggaggtaggtactgttatcatcatcacgtcacagatttggaaactgaggcacagagctgctaagaaactcattcaaataagcaaccgagctgggacttgaacacataagcacccagcagggtttacctagaaagtcattttgggcacaggatcttcctccatatgcttcctaaagagatgcaaggttgcgttttgattgcattgtctagtctagccattggaaatacatttacctcatgaggttcagacttttatagtttaaagaaaggaaaggaaaggaaaggaatggaatgttctccctttgcaaaacctcatgctgtcctttaatcatgtccattgtgctgtgtggtctcgatgtcttccaagcagtttgggacttaggtttcattttatcagtaggaatcatttacatagactgctgtgaaggtcctcttgcctgcgaagttctctaccactgcctgacagtgcctgaaattccagtattaaataatcattcctttgaatattcaagtttgattttacagaattctctcttaaaatataaagatccctttaaaggataaatttaaatccctcaaaaggatggcaaatatgtaacaccatattatggaaaagtttccatagtatgtagaaggttaaagggagcaggaaatggatgataaatagggagatgggtttcccagagaaggcgccagtgaaaaattgcttcttgaaatccctgaatttatgtgttgcagcctaatgacatattttcacaaaattgtgagcagcagtaaagttttactggatggattcttttatttcaatgattttcctcagtgttgactgcttagttatttcaagaaaagctaattatttagaaacattgctacccattactgatgtgttcatacattaaaaaactattgtgtctcagataataatgaaaagagagcctgttttgaaatttgccggaatagctctattagataaccacaaaggaaatagtataacatcacacaataaactatctgtctttgaagcaatcaaatgtcccttttggctatggtggtggttgtgactgtatgcctatagtggaggctggtagatgtctgaggttgatgttgcattttcaacaacattaagtggccctactgaatttattattccttcttttgttgcatctactactctgattgtcaagttattgttaggaaaaaaatcacaacgaagattctaaagcataggttaagtacaagcaaatcagatccactgtgcgaggagctatattctaggagaactgactaaaatgtgcaaacaaaacaataatgaaaggatcatagccttgttgaaaataatgtataataaaaaagtaagacccagagtaattctgctctaatgcaaaaaatgtctgtttttgtattggctttacgggttttacaagaagtgatgaaaaagcagggtaatgttagcagtgaccttgagtttcttctcctataaaaaaatgtaggctgatgaaaccttttgtacacccctcagggctgtgtgagaatcaagagagtctgtgtatgtgaaagtccttctggcctatcatgtgtgagatatcataattacaaactttgttcagaaacatttggtgtgggagacaaaggtttgggccctatcatctctactcatgttatcaggagatagcgttgctaagtggacagacgtgactatctgtgaagtccacaaggtccttgaaatttcattagaatactcttctttccaatctttattcagattctcggtccaccctaacctcgaagtgttaagaaccactgtttgggaagaggtgttttctgtatatttttctaaatgatctgatagtaaaagaaacagcttcacagaccattttgccttatcaaaatttcatcgattcttagaatttatgaagcccagattaaagatacaagaggatttaactctactggggacacagtccctttgacagagtctcacccatcagggctgcataccgtcaggcaattgatgcaccttaggtttgagtcaatacttcaaagaatgtgctgattccatggcatggcatgaagtgtcacaaaaataatatttgcatcatattctggggacatgctgcatggactttgggtgcaactatatggattttggtgaaaaatttatttcattaactttgcataattataagaaaaataaaacacaaagaaagggcagatattaaagactgaatttgtaaagctctcccaaataaaatatttgcagatgctttaatgagaaatttgtgcttgctttagtttatcgggtttaacacttgaaatgactgcatgaaagatttgctcaagacttgtagatgaaaaaatttttttaatgtttcttgttgatgagaaacttaattcaaaataatttgtcatctaatcaaaaaatatatgaactgaaataatattttaatgtctctaataaacttcgtttcctttctttgaacatttcttatgaattccaaatcaaatggaacctttttatatgaagtatttcaaactcatgaaactctaactttgggaatgtgtatgtgttgttgaaggagtcctcatgaaactagcgtggacaacactagattgaccactggctaccaaccggcgtaggaattcaacctacatgaagactcagagtcaggacccaccctgcacccccaaactgttgcgctttcccagagcccctgccgtgccgtccttccctgactttctagttcccacccctgaccagctcttgggctctctgcactgagctctctgccctgcaactttagtacatgggatacaagcttcatcagctccctggcccttgttcagaacagctgctcgccgtgaagtggacatgcatgtgctagaacatctttccttgtactgaggaatgataaagcgctggatgatgcccatcctgcttactgtctctggggacaaattgggaacatacaaggtgccaatcccagatgaaatggcatgatgctagcgtctgtgtcttgggggctctgaatactccaggtctggttctgcccctgaggactgaggagatcaatatctccactcagaatgtcctagtagtaaaactagtagtaaagctctgggccagggtttctcaaacttcagtgtgtgtcaggatccctgttaaggcttgttgaaatagattgctgggccccatccccactttctaatgggtaggcctggggtgctgcttaagaatctgcatttgtgagaagtgtccaggagatgttgatgccactggtggggaagaatactttgacagcgactgctacagaatatagcatttctaataggattcaatgaaaatttccactttcctttgatacatttctaaaatcaatcttttcgaacctgtatcccaagaaaatgtggtgcatatacaccatgggatactacatagtcataaaaaaaaaaaaaacaaaatgatgtcctctgcggcagcatggatgcagctggaggccattattctaagtgaatcaatatagaaacaagaaaccaaataccacatgttttcacttataagtggaagccaaatactgggtatatatgggcctacagataggaacaataaacactgaggactccaaaaaagaagagggagatgggcaagggtggaaaaaccacctattgggtacgatgttcactatttgggtgaggggctcaactgaagcccaaacctcagcatcatgcaatatgtccatgtaacaaacttgcacatgtaccccttgaatctaaaataaaatgaaaaaatccctacatccatctgtcttcctgaaatttttatagcacacagaagattcttgccattcacagatttaagacgtgcagtttagaaatatgaaagcaacccaaataaaataacgttgaatttcactaaaacacgaatttgaattgtgtgttatgcagccaccatgtggatatggatttgcagtcagaagctggtgagtgaatctacttaaatgccagtgtcaacaactcaaaccagctttgtttgctactcatgatgactgtacattttaagtgaataactatatattctcatgccagggttacaaactcaaatgtctaacgggtccaggaagcaactgcaaatgagtggagtggtgtaggtagagaatgggttgaactggtgggcctgtaaccatttaggagcagaagccttacagagctccagctcatggacgccaggtaggaatgtgggctactttgccatgtcttccaattttgaaagaatccagaaatccagatttttacacgaaacccccttccccttttaaggtcagtcttctgaacacccaacaaaacacatttacaagccaattctaaatttgcttttatcatcaaataacaccccacaatttgagcattagtgaggattttggaaacggagcttttgagaatgtcaagtgtgcactgttcgatattttaatagtttagtttggtttaaatatgtgactgccctttcgcagaaactttactttaatgaaggaaaagaagcgtactacggaatttcattcttggggcaggcgatggagtaggagattcttcacagaataactaaaacaaactttaaaaattatgtattcaatgccacgagtacagagccctgggccaagcagagactgtgtactctctgctgtgccttatcattattcacattcctttaccaccctgaaaatcattttgagaaactaacctccagttgttgaaagcagatataattttcctaaaatgaaacaatttgccaataaaatatttttatccaaggaccaaagttgctgtgtgacagccgaggtgtttatggtcaactcccaattatccagaaccaggctgttggattttcgtattaatccttcttttctttgcataccctctcatgattttattgcttgtactgctgccatcataagcctggcaaatcgaatgataggatgtggttttgctagcaattcttttaagagtcaggttgagaggctcttggaacctacaacttaatttgaagttagcgttttggcatttttcatttatacattttcctgccaatcctgctttcatttaagtagctgaggatgactgggagttacgtttcttctctttccaaaacacccaggatttctggtgttttgccttgaatgggaaaaaagcccagtctttttataggagaagtgagaggataaacgctggatatcagggagggctgagcgtcgggccagcgtgtggtagggccaggaatatcttgagaagtcacttcgcagcactgtgccttagtttcctcatgtggaatatgcactcggtgggcaaaattatagattgtcccaaatgggtctgcagagccccagcatttctgtccaggtgcgtcagaggacttggggagctggggcaattatcttcgcctcatctacattgtttttgtctgcttaaaagtgtatactattaaatagtttgaaaactccaattcttaatgatcttagaaaaatttaagaaatctgcattttgaggggaatgtttgtgctccactgcaattcatatgtatttttcaattcaacttctattatagattgaagggtacacatgcagatttgttacatggttagattgcatgatgctgaggcttggggtcccagtgatctcaccacccagaccataagcatagaacccaccaggtgattcttcagcccatgctcccctccctccctcccgtctagtgatccccagtgtctgttgttcccatctgtacaattatgtgtattcaatgtttagctcccacttataagtgacaatatgaagtatttggttttcctttcttactttagtttgcttaggataacagcctccaggtgcactcatgttgctgtatagggcaggatttcattctttttatggttgcatagtattccgtggtggatatgtaccaccttttctttatcaaatccccagttgatgtgcacctagattgattccacatctttgctattgttaatagtgctgcaatgaacatatgagtctttatgacagaatagaaattcatatgtcgaaatctaatccccaatgagatggacttaagaggagaggtgatggggaggtgatgagtcatgagagtggagccctcatgaatgggattagtgcccttatgaaaggggcctgagggagcttgtttcctgctcccttcacacgaggatgcagcaagaaggcactgtctaggaggagcagataccgaatctgctggtgtcttgatcgtgaacttcccagcctccagaatggtaagaaataattttctgttatttgtaaatgatccagtctaaggcatttggttattatagtagcctgaacagactaagacaaagtcttattcactcactgtggaactgccatgctcacatcttctgtgcactgttcttacgccacatgtctgataggaatgccccacaccccctgttgattagctaatttctatccatttttaaactcttggtatatatgccaggtgtcttcaatatgtgatgagggctgggtgtggtggctcatgcctgtaatcccagaactttgagaggccaaggtgggtggatcacctgaggtcaggagtttgagacgtctgaccaatatggtgaaacctcgtctctactacaaatacaaaaattagccaagtggggtggcatgtgcctatagtcctaggtactcgggaggctgagacaggagaattgcttgaacccagaggcggagcttgcagtgagctgagatcgtgccactgcactccagcctgggcaacagagtgagactccatcttaaaaaaagaaaaaaaatatgctatgagttatttgagagcaggaattctgttcacattgtccctggctgtataccacctggtcctaagcatatagtagaaaaaacttctttaatgtcgtaaggtatatttttatagtttaatcagtgaacatatcggtagtaataacagtcttcacatcgaggtagtcaaagactataactttattttcctctaattttgatcactacttgctaccttctcccccttttcccatcagggtgagggaaatttaatccgattaaatgtaggtgcctctgttctctatggctgcatatgagttctgggagcttagggcagaggcatgaggaggtagggacattctagcccctaacacaggttccaggttgctgctgagacaatcggttctcgtcccatgaccacctctctgctgtctcagagactatatctctttttccattaggctagactgtaaaaaacaaacaaacagcaaaaaaaaaaaaccttatttcaggaagaaatactactcccttaaactgaaatttctgccatggaaattctctcccaatattcatctatgccctgagttccttttgttctcccaggacttcaactcttacacaccaaatccattgagaagcctgtgcttctgatttcagccctgtgatacctcacacctctggtgctgagcatagagtgccctagatacttgagtagaagctggagatggtgtgggaggaggagagaaaaagaaaaatccacccagagaaaaaattaattagactgtaggtcttgagcttgaaacaattgtaatgttcttggaggctggtgttttattttaaatattcaaatgaattctgtactctgttcattaaacattcattttgttgcaatgtaaaatcatgtcaagttattttccatagaaaattacatattttattgcaatgatatgaaaaacaaatcttgagaagaaaattgcaccttctccttaattttagtataaatttagaatttgataatatcagagaaaaaacgtaaaagtatttctgatttcagaactcccagagaccaatattctcttgttcgtaacaatctcagtgaaagggaaaaacaaagtagaagaataaaaaacttaaaaaataactattacttacttttacttaattgcctttatcttagaagtaagttattttctaacaggaaagtcagaccagcagctaaaaataatgtgaagagtccacattccagtgagtttgcctaagatgaggaagctcaatagcttcttagacttgtaggcagatgtaaacccaagaaagggggattttcataataaataggaaccagccagtggttgtgtgtggatgagaaaaccgtagttcattagttaggctggtgggtagcctctgtattcagagggtgcacaaagaaaacaatgacagcacccactgccttcaccactgaactggcgaggaactaccagatatagtgattgattgcttaagtgtgtcaccactcattagcgagtaggtggctttctgaaaaaaccaagtttgcttcataagacttcagtgctcagatagaataggaacatggcctcctagggtgggtgcttgcagagagaaggtgaatgtctgccatctttggagggctgcgatgctcagcaggagccaggcaagtatgcaggacaaactttcccactcacatatccaggaagaatatgaacattaaggaaccaaagaatagagtgaggtctctaagtttcaaaataaaaatgctgagtcttcaaaagactagaattttcttttctgtgtgaagacagacatttatgtcacagccaggactaaatcctacttacggtttcttttaaaaaatttatttatttttttaaatgggcaaaattatatatatttatggtgtataacatgatgtttcaaaatatgtttacattatggaatggctaaattgagctgatgaacatatgcataacctcatatacttttttgtgttgagaacacttaaaacctactctcagtatttttcaagtatataatacattgtttctaactgtagtcaccatgttgtgcaataaatctcttgaattactcctgtctaactgaaactttgtgtcctttcaccaacatctcccaatccccattttttcctcacaacccctggtaacctccattctactctctgcttctatgagtttgcctttgttagattccactataagtgagataacacagtatttatctttctgtgcctggtttatttcacttaccataatatcctccacattcatccatgttgttgcaaatgacagaatttcctgcagttttgaggctgaatagtattccattgtgtatatgtaccacattttctttcttcattcatctgttgatggacacttaggttgattccatatcttggctattgtgaataatgtcacagtgaacatcagggtgcagatatggcttcttgaattatgtatgtgttaaaaaccagctccagtgattcctgtgctcagcgtgtttgttagttttaccagtagtgaatggatttaggtgtatgtctctgtcagtgagcattagctctgtccctgactctcccttggtgtgccattagtagagtcttctacagaatgtgggagagggagtgctgcctctgccagtcaaatcttgtctgaatagaaactgcctatttcaaacaactctcagagttcagggttctggtatgagctttatgtagatattagtcacacatggggaaaagaattaagaaaagtataaaagaaaaaaataactttgtagagtttgtacattttcctttttcaattagctatagctaatggagtaaccaagtcagtattttccccctcaatagtttgaaataagcctagatctttttttttttgagacggagtctcgctctgtgggccaggctggagtgcagtggcgtgatctcggctcactgcaagctccacctcccgggttcacgccattctccttcctcggcctcccgagtaactgggactacaggcgcccaccaccacacccggctaattttttgtatttttagtagagacggggtttcaccgtgttagccaggacggttctgatctcctgaccttgtgatccgcccgcctcggcctcccaaagtgctgggattacaggcgtgagccacctcacccagccaagcctacatctttacaaatattatattagtgtcttaaagtaaaatagtataatattatacactagttaaaaatcaacaacaaataggcttgcccaattctccttatcactgagtaatcatcatttgtgaactcaaatacaactgaaaattagccacaaggttttgggattcctctgactgttctgtgaaaggagcttaataacatattatctagctaaaccagggaaatggactgtatgatgagttgtgctccctttttgtaccaatgaccagcacttattttgtcaaatagtgtgagtaagtctttttggaagaaactgaggaaaacatatagaatgtaatagaaaataatacagccctctttctatggatcagcttgattctagcataggttttagggtcaatggaagtggagggaagaacacatttttattgaatatgcactattattctaagagctgaagatatgggtaaacaaaacaaagaaagccaagccctcatggagtctacattacacacacacacacacacacacacacacacacacatacacacacatggtatcaggtggtaataaatgcttcaaatatatgtgaatcagaataaaggggctgagagtcatggcaggaatgatatttcagagagttgtcaggggatgcatctctgaggaggcatcattagagcaaagacttacatgaagtggaggaagaacccatgccaagttctaggccatagaacagaaatgtacaaaatcctgagaaggggattgagcatggtgttttcaaggagtagccaggtgacctgtgtgcctggaatgagcaaggagaaagtgctaggagatagagttggagaggaaacaaattatctggggcccatttggggtctgcccatttggcattcttcatcacaaaagtgtctccctctgttgcccagggtggagtgcagtggcacagacatggctctctgcagcctcaacctcccaggctcaagcggtcctcccacctcagcctgctgaggagctaggaccacaggcatgtgctaccctgcccttgcttacttttacttttgtttttttttgtgcagggtctcgtcatgttgctcaggctggtctcaaactcctgggctcaagctatccttccatcttggcttcccaaagtgctaggattacaggcatgagccaaggcagtcggccatattttcacacttaacacaaaatgaagctgccaatgagaactgtgtgagaaagcagagcaaaattcactcaaataataactaatactaatcactcatcctgagagtgttgggaaaactttggaaggttgagtaaaggacagtgataatgatttgatttatgtctaaagaggccaccttgccattatgggaagagtagaattttaggagggcaagattagaaacaaggaaagcaggagtcgagctgatggtggatttaactaagacagctgtggaaggggtaggaggtggtcagatttgtgatgttttgaagtttgagccaaaaggatttgctgataagtgggggatgagatgggagggaaagggttatattaagatgactcctcttcttgggcctgatcaactcagtgaaaggaacggtttactgagactggaagaggagtatgccagggcaggggtgaggaatcaggggttctgtttgtacattttaagtttgagattcctattaaacattcaagtggagatgtggaatacaaagtatacagagttgcagaataacaacaagatctagcttgatgattatttaaaaacattgtttctgtgaaatattccaataccctagacttgtaattaccttagttttgtaatattgcaagtaataaagctgggatccactatttcccttttgagtcagaagaggtaagatctcttgaattgtgctttcgtctcatattttaggaggtattaagaagaaatttaggttggacgtggcagctcatgcctgtaatcctagcactttgggaggctgaggttggaggtcctcatgaggccaagtatttaagagcagcctgagcaatacagcaagactttgtctctacaaaacataaaaaattagctgggtgtggtgatgcatgcctgtagtaccagatactcaggaggctgaggcaggaggatcacttgagtccagggggtggaggctacagtgagctgtgattgcaccactgccctccagcttgggcaacagagtgagaccctgtctcaaaaataaataggtaaataaataaataaataaatggaatttacttaacatttttttttttaccccagcggaaacatgacaaaagatataaaaaggccagtcaccaaggaagttcattcggaacacacgctgaactttagtagcagtaatcaagtaaatactaactaaaatgaaataccaattttaatattttagagtggcaataattttaaaagattagtatatgtgcaccctcaaaaatattggtgggaatgtaaattagaacaacttttctagactgaattttggcagtctatcaaaagccttaaagtatgcatatgctttttaagagtaattctgcatctaggagtgtatcctaaggaaatattctgagccagatactaaaatatttattgcagcagtatttgtaaaggtagaaaaattagaaacagcttacaaatacagtggtagggaattggttaaataagttatggtatatttatgtgatgtgattacttgtttttgaagactatttcacaacaaagataaatgctcattgtatactaagaagaaaaagtaggttatagaataaatcacacattatatgaattatgcataacacacatagcccacctacatacatagaaaaaaactgaaaagacttccaccaaaatatttacagtggttttctctgagtagtgaaatagcgctgatttttacatcctccaaatatcttttatactttctaaaattttcataatattcacatattgcttttatatttagtgtttaacatttatgaatatttattaggttggtgcaaaagtgatcatgttttttaccattaaaagtaacagcaaaaattggattcacttttgcaccgacctaatagtagagagatgacatccttggacacttttgtttttcttataacaccatattgtaaaatttgttctcctatttattattgttggacatttgtggtttagaaccaagtaacttttataagtgaaataattttgtgactcatatacaaaaggttttcttttcttctctcaacttgatattgtgccagtggtcctgctgctacttaatgacagctatcattatactacattatactacagtgatacaatatactagaagaagaaagtacaatatggaactaacaaccagttagcagagctgaattaaatgattctgagtccgtggcattgcataaatcctaaatagtaaagaagtgagcaaatatgttgaatcaactaattttttttgctatgtaaattctaatcagactgagcattataatgccagaatattccttaaaccagaaatttctattctgtaaactctcaactttaatttgggaattgttgtggtaggagaagccatcagttcctagctggaaatttagatggagtgaaagttccttcctttaattactgactagaaaccatctgaggaaacaatatgcaaaacactacaattcattataaataattatgagggtgaatagaaatctatagagaaaagctcaaacttctatgggaaatatacgtatctgcgtatgcatgtgtgtttaaagtgtttaactggctaagttttttaagtttataaatggcatgtatgtaaaaggacataagaatgattttcaatatgatatttttggccttagactaactgtacaatgactccaaagcaaataatatgccaaagtgctaaagtaatttaagcaatcctgtacgtaattcaagcaaaaagaaaacgtttcccaaatcacctctaacacgctgttttcccctgaatgacctggataattgctataatacttcattttatttggactgtggagacctgattttacatctttttaaaaatgtagaacacagagagaaagagagagagagagaagcataatgcccttttctaacagaatttcccaatgaaattgaaaaagaagcatcttaccccaaagtagtaggataaaccaaacaccttaacttctgttagagggcctctggaagaggaatttaaatacaatggaggcaggttttactttttctctagtgacaagttatttctattaattttggtaaaaataatctgctgaaagcattatttataattaaatgaaaagaaatatatctttacaagcttataaattagttttaatatctttctatttttagaagttacattgctgggtcaacctgatattccagaattcacttgtcaaatgtaaaaaagagaatttgagccacaccattggtatgctttctgaatgttttagtgcctgagtgtaaggaagagtcataaaccctataaacagtgtgtgtgtattggtagtctgagccctttgaggtgggcttgggggactgcacccaatagggtttcttaataatgttgagtctttcaggactcacatgactatgtgttggttgttgtcagagtgaaatacttgaattacctctatctagtctctgtttacaatctcctcttgaggtttctgtatgccaaattgtacttaaaaaacataaatttcccttcaaaggtagcttgggagcctgaagtgtggctagggactcctaaatgcaaaggataatcaaggtcctctcaaatgtaggtactgcaatttgtttaaaacatagcacggtctagactaaagaatgagacctctacagatgatttaactaaaggaaaaggtacaggcactgctgaaaataaacacttctgtaattaccaaaggcctttatttagttaggactatcttgaggatgtagctgagggagcagtgatttgcaatgccaccccagaccccagaaacaaacaaacaaaccaaaccaaatcacagagtgacactttatttcttaatcacattggctaactggaatttcttaagtggctccaacttggagaaaagcaaaatgtgtgaagttagtgaaagattactgccttgattcaccctttaaatgcttggattctaacaatttcaattatttgttcatgttctccttatttccctaatgtatcatttacgtcacaaaactgcccatttggcattctttatcacaaattataatttttcactaaagcttgcaataagccaaactgagtcacgttccacataccttttgtttggcagaaaccactctagtgctgaatgaagactgttttggccgatccattgcgccttaatttgtttggccatatgactgctttctgtcttctgcagaaaaaggctctgtagccagtggtttttatttatgttgcttcaaagccatggcagccttcattttacttggaagcttattttattttggctttccccaccagcagatcatgtccgattttctgcctttattctctttattataactattttgggaagtatgtatcagcacaccatgattaaaacactgctgttgatgtttggattaatgctaaggcttataatagatacctgaaaatgaatatatacttgaaagaggctttcacctaattgatagaattgttacctttcctaggaactgggggatacagcttcattcattaacagttgcacattcatataaaaaaaaaaaaaaaacctctttcactcactgatgtcttgacctttcattcgccatttcctgggaatcattgaaacctctgtacctaagccagggttgtaacaatacatttttgttatgattggcaaactagcataattatcagcttgctggtttacgtatttggccaaaaatgttaccagcggtgaatccatatgggtctgcagcaacctcaattcttgcttcctcaggagaaagaactcaatgaggagcataaggcagagtgagagaacaaggcaagttttggaaagcaggagtgaaggttcattaaaaagctttagtggggaggggccaatatggttgataagtagcagctctggtctgcagccttaacctagaagaacgaaaacagcaagtaaatcctgcaccttcagctgaggtatccaggttctctcaatgggactgactaggcagttgctgtgagccaaggagagtgaggaaaagcagggtggagcgatggcccaattaggagcttcacagggaaacgggagctcccacccacccccagccaagggaggtggtgagtgattgtgctaccttgccagggaaaccatgcttttgcatggatctgtgaaacccgtggatcaggagatcccctcctgagcccacaccaccagggccttcggtcccaagcacagaactgtgcagactcttcatgaccactttccttgtggccagccacagcaggctggagacagcctaagatgaccgagttactagtggggaggggcggctgccatcactgcagctccagtcagccattttcccctcctggttggggggaggctgggcggtttttagtgggaggaattccccaaagtgcagcacagcagctgtggtagattgtggccagactgcctctttaggtgggacctggatccatccttcctcaccaagtggggccgccccatgggaatttcagcaactccagccaggggtttatggagagaattctgatctccctgggatggagtccctgatgggctgggtggctgtggtctccagttcagcagacttaatctttcccaccttctggctctgaggaggcggggtagtctagatgagtggtatttccccaagcacagtgcacccactctgtcaaggggcagaaagagtgctttgttaagcaggtctctgatcctgtgcttcctgactgggtgagacccccaacaggggtaaccagacacctcatgcaggagagttccagcaggcatcaggtcagtgcccctctgggatggagcttccagaagaaggagcacgcagctatctttgctgttctgcaacctctactggtgatacttccaggtgcaggagggacccaggcaaatagggtctggagtggatccccagcaaactgcagcagccctgcaaccctgcagaagagagacctgactgttaaaagaaaaacaaacagagggccacaacagcaacaacatcaacaaaaaagacctcacaaaaaccccattcaaaggtcaggagcctcaaagatcgaaggtaagtaaaccttcaatgagaaaaaatgagaaaaaaatcaacacaaaaacactgaaaattcaaaaagccagagtgcctcttctccaaatgatcacaccttttcagcaagggcactgaactgggctgaggctgagatgagtaagttgacagaagtaggcttcagaagatggataataatgaactttgctgagctagaggagtatgttctaacccaatgcaaagaagctaagaaccatggtaaaacattacaggagctgttaatcagaataaccagtttagagagaaacataaatgacctgatgaaactgaaaaacaagtatcaatagctgaatagatcatgcagaggagacaatctcagagctgaagtctgtcttgctgaaataagacaggcaggcaagattagaaaaagataaatgaaaaagaattaacaaaacctctgagaactatgaaattatgtacaaatgtgtccagaattggtgggttcttggtctcgctgacttcaagaatgaagccgcggacactcgtggtgagtgttacagttcttaaagatggtgtgtctggagttttttcctttagatgtccagatgcatctggaatttcttccttctggtgggttcgtggtctcgctgacttcaggagtgaagctgcagaccttcatggtgagtgttacagctcataaaggcagcgcagacccaaagaatgaacagcaacaaggtttattgcaaagagtgaaagaacaaagcttctacagtctggaaggtgaccagagtgggttgctgctgctggctcaggtggcctgcttttattcccttatctggccccacccacatcctgttgattggtccattttacagagagttgattggtccattttacagagagctgattggtccattttacagagagctgattggtctgttttgacagagtgctgattggtgcctttacaatcctttagctagacacagagtggtgattggtgcatttacaatcctttagctagacacagaagttctccaagttcccacccgacccagaagcccagctggcttcacctctcactggcacttgctgcaggactctgcagcacccagcctgcgcactctggcagcccagagggagcctgtcccccatcaagtccagcaggcgccagctggctgcacccgtgcccacccagaacctgcgctggctcgtgaatgtcacgcgcagccctggatcccgctggcaccttcccctccacacctccctgcaagcagagggatctggctctggcctcggccagcaccagagaggggcccccacagtgaagcagtggtgggctgagggctccttgagcatggccagaatggatgccaaggccaaggaggtgctgagagcaagtgagggctgctagcacgtagtcacctctcacaaagactgaacctactactgattgggatagctgaaagagatggggagaatggaaccaagttggaaaacatacttcagggtgtcatccaggggaacttccctaaactagcaagacaggccaacattaaaattcaggaaatacagagacccccagtaagatactccatgagaagattaaccccaagacacataatcatcaaatttccaaggttgaaatgaaggaaaaaatgctaagggcagccagagagaaaggccagataacctacaaagggaagtccaacagaataactgtggacctctcagtggaaacactacaaaccagaagagactggggagcaatattcaacattcttaaagaaaataatttccaacccagaatttaatatccagtcaaactaagctccataagtgaagttgaaataaaatccttctcagacaagaaaatactgagggaatttgtcaccaccaggcctgccttgtaagagctcctgaagaaggctctgaatatggaatggaaaaaccattgccagccactacaaaaacacactgaagtacacagaccaatgatgctgtgaagcaactacattaacaagtctgcaaagtagccagccagcatcatgatgacgggatcaaattgacacataacaatattaaccttaaatgtaaatgggctacatgccccaattaaaggacaaagaatggaaagcaggataaagagtcaagacccattggtgtgctgtattcaagagacccatctcacatttaggctcaaaataaagagttggaggaaaatttaacaagcaaatggaaagcagaaaaaagcaagggttgcaatcctagtttctgataaaacagactttaaatcagcaaagatccaaaaagacaaagaagggcattacataatgataaagggttcaaatcaacaagaagagctaactgtcctaaatatatgcacccaatacaggagcccccagattcataaaacaagttcttagagacctacaaagagacttagactcacacacaattatagtgggaaattttaacaccccactgtcaatattagacagatgatcaaaacaaaaaattaacagaaatattcaggacttgaactcagctctggatcaaatggaactgatagttatctacagaactctccaccccaaaacaacagaatatacattattcttggcaccacatggcacatttactgtaaaactgatcacataattggaagtaaaacactcctcaaaaaatgcaaaagaactgaaatcataaccaacagtctctcagaccacagagcaatcaaattgggattcaagattaacaaactccctcaaaaccacaaaactacatggaaattgaacaacctgctcctgaatgactcctgaggaaataataaaattaaggcagaaatcaagaagttctttgaactaattgaaactaatgaaaacaaagagacaatatactagaatcactgggacacagctaaagctgtgttaagagggaaatttatagcactaaatgcccacatcaaaaagctagaaagatctcaaatcaacgtcctaacatcacaactaaaataactacagaaccaagagcaaacaaaccccaaagctagccaaagacaagaaataaccaaaatcagagaggaactgaaggagatagatacaaaaaacccttaaaaaataaatgaatccaggagctgttattttgaacaaattaataaaatagaccactagctagattaataaaggagaaaggagagaaaaatcaaatagacacaataaaaatgataaaggggatagcactactgaccccacaaaaatacaaacaaccatcagagaatactgtaaacacctctatgaaaataaaatagaaaatctagaagaaatggataaagtcctggacacatacactctcccaagacagaaccaggaagaagttgaatccctgaatagaccaataactagttatgaaattgaggcagtaataaatagcataccaaccaaaaaaaaaagttcaggaccagatggatttacagcggaattctaccagaggtacaaagaggaactggtaccatttattctgaaactattccaaacaattgaaaaggagggactcctccctaacacattttatgaggccagcatcatcctgataccaaaacctggcagagatacaacaacaacaacaacactccaggccaatatctctaatgaatattgatgcaaaaattctcaataaaatactggcaaattgaaaccagcagcacatcaaaaagcttatccactatgatcaagtcaacttcatccccaggatgtaaggctggttcaacatatgcaaattaataaatgtaactcatcaaataaacagaactaaaggcaaaaaccacatgattatcttaatagatgtagaaaaggccttcaataaagttcattaaaaactctcaataaactcggtattgaaggaaactacctcaaaataataagagccattcatgacaaacccacagccaatatcatactgaatggacaaaagttggaggtattccatttgaaaaccagcacaagacaaggatgccctctctcaccactcctattcaacatagtattggaaattctggccagggcaatcaggcaggagaaagaaataaagcgtattcaaataggaagagaggaagtcaaattgtcattgtttgcagacgacatgattctaaatctagaaaaccctatcatcttagcccaaaagcttcttaatctaagtaacttcagcaaagtctcaggatacaaaatcaatgtgcaagaatcacaaacattcctatacaccaacaacagacaagcggaaagccaaataatgaataaacctgcattcacaattgctacaaagaggatcaaatacctaggaatatagctaacaagggaagtgaatgacctcttcaaggagaactacaagccaccacttttcaaggaaatccaagaggacacaaacaaatgaaaaaacattttatgctcacggataggaataatcaatatcacgaaaatgaccatactgccccaagtaatttatagattcaatgcaattcccatcaaactatcactgacattctccatataattagaaaaacactgtcttaaaattcatatggaaccaaaaaagagcctgtatagtcaagacaatcctaagcaaaaagaacaaagctggaggcatcatgccaccagactgccttttcctggcgccggctgcgaccaattattatttagagagacagctttacgactgcctgatcatcacctcatggttgcctgacattcctggtggtagtggggccttctcctgccctgctcctgtctgcctgcctacctgctggaacaaaggtagttgtcccttcaagagatatatggaaggatattagctggctgttgaacttgagcacacactgtaaggcaaaaacagatggctagtatactatcttcctgttttcctaactttaaaaagtttacctgatgtatttaggatataattttgggatgaaaagctgtaaggattaatagaaaagtaggagaacatatgtaagaagaatgtggttgggaaggacagggaaattaggtaaaaatttgtaaagcaaacaggcttctgggaggggatgtgtgttttcctcatcctgaggtttcttccatgtgaaggacactctattagaataatcctcttggctactctcagtctctctgcccttgggggagatggagtgacctgttttattggtgaggtgggaaggaaaagaacagcattttcccttttcccttcctctagggagagagcttcccacagagaaccttgtcctctgtattccatgtcctaaaactaacagaggcaggtaggtccccaggcagtgcctgtgtcaggaatggagaattatttctaattttggagttcagcattatgaaggtcacttgtctgctttttcttaataaaactttataaaggataaaggtaatattttggcatctatgtgacaatgccttggtcttatttcacagttgagtaagcatctgtgaagatgccctctaaagtcccaaataagattactcaaaagtaaatcaaaacaccctaagttggctgttctggccatgagggagttgttgcagctagacttgctcttctctataaacagcaaaaaaaaaaaaaaaaaaaaaaaaactggacaaaatatgtggaacaattttcagacactggacaatatgaaatacagggctgtgattcctgagggaaagaagcaaatatgatgagtcatataattgacctggctatctgtgtggaggcattttctggacctcagtacagggagtggggacacagacagagcgcagtgatcttgctaaagtgagaagatggataccaacagttgggagactgaggttcttgtaatttgtggggcagagatgagggagttgtgctgaggaaaaccaactaaccaatcaagcaacaaacaaactaacaaacatctctagaggtcttccctttagtttttgcccaaatggtaaactgcactttcacaatttgaagatccacagggtcagagaatacatgctaggatctttaagtgaaacagttcttagggctcacatacaactgaggaagtttgattttcaaccaactggaatgcattgacctcgttgaacacccaggcgttccattgagatcccagaaaaattagcatatctaaatctaaaggaaaagtactctaggttcaccccaacaaatcttaaaaattgccctcaacaaggtcaaattgattatttttctccttttataaaattatacttaaattctgggatacatgtgcagaacgtgcaggtttgttacacaggtatacatgtgccgtggtggtttgctgcactcataaacccatcatttacattaggcatttctcccaatgctatccctcccctttcccccaaccccctgacaggctccggtgtgtgatgttcccctctctgtccccatatgttctcattgttcaaatcccacttataagtgagaacgtgtggtgtttggttttctgctcctgtgttagtttgctgagaatgatggtttccagcttcatccatgtctctgcaaagggcatgaactcatccttttttacggctgcatagtattccatggtgtatatgtgccacattttctttatcaggtctatcattgatggacatttgggttagttccaagtctttgctattgtaaatagtgctgcaataaacatacgtgtgcatgaatcttcatagtagaatgatttataatcctttggatatatactcagtaatgggattgcttggtcaaatggtatttctagtcctagatccttgaggaattgccacactgtcttctacaatgattgaactaatttactctcccaccaaaagtgtaaaagtgtttctatttctccacatcctctccaggatctgttgtttcctgactttttaatgatcaccattctaaatggcatgaagtggtatctcattgtggttttgatttgcatttctctaataaccagtgatgatgagtttttaaaaatatgtttgctggccacataaacatcttcttttgacagttgtctgttcatatactttgcccactttttgatggggttgtttgtttttttcttgtaaatttgtttaagttccttgtagattctggatattagctctttgtcagatggctagattgcaaaaattgtctcccattctgtaggctgcctgttcactctgatgatagtttattttgctgtgcagaagctctttagtttaattagatcccatttgtcaattttggtttttgttgtcatggcacttgatgttttagtcatgaagtatttgcccatgcctatgtcctgaatggtattgcctagggtttcttctaggatttttatggtattaggtcttatattcaaatatttaattcatcttgagttaatttttgtataaggtgtaaggaaggggtccagtttcagttttctgtatatggctagccagttttcccagcaccatttattaaatagggaatcctttccccgttgcttgttttgtcaggttcatcaaagatcaaatggttgtagatgggtggtgttatttctgaggcttctgttctgtttccttgttctatatatctgttttcataccggtactaagctattttggttactgtagacttgtagtatagtttgaagtcaggtagtgtgatgcctccagcattgttctttttgcttaagattgtcttggctatacaggctctttttcggttgatcgtagtggataagctttttaatgtgttgctggattcgatttgccagcattttattgaaaattttcacactgatgtttaccagggatattggcctgaaattttctttttttgttgtgtctctgccagattttggtatcagaatgatgctggcctcataaaaagagttagggaggagtccctctttttctattgcttggaataattttagaataaatggtatcagctcctcttcatacttctggtagaatctggctgtgaatccattcggtcttgggctctttttcattggtatgctattaattactgcttcaatatcagaacttgttattggtctattcagggattcgacttcttcctggtttagtcatgggtgggtgtgtgtgtccaggaatttattcatttattctagattttctagtttatttgtgtagaagtgcttatagtattctctgatggtagtttgtgtttctgtgggatcagtggtgatatcccctttatcaatttttactgtgtctatttgattctcttttttcttctttactagtctggatagtaatctatctattgtgttaatcttttcaaaaagccagctcctggattcactgatttttttgaagggtttttttgtgtctctatctccttcagttctgctctgatcttagttatttcttgttgtatgctagtttttgaatttgtttccttttgcttctctagttcttttaattgtgatgttagggtgtcaattttagatctttcctgctttatcctgtgggcatttaatgctttaaatttacctctaaatattgctttagctgtgtcccagagattctggtatgttgtgtctctgttcccattgctttcaaataacttatttatttctgccttaatttcattatttatccagccatcattcaggagcagattgctcaatttccatgtagttgtgcagttttgagtgagtttcttaatcctgagtactaatttgattacactgtggtctgtgagactgtttgttataatttctgttcttttgcatttgctgaggagtgttttacttccaattatgtggtcaattttagaataagtgtaatgtggtgctgagaagaatgtatattctgttgatttggggtggagagttagtagatgtctattaggtccgcttagtccagagctgagttcaagtcctgaatatccttgttaattttgtgtctcattgatctgtctaatattgacagtggggtgtttaagtctcttagtgttattgtgtgggagtctaagtctctttgtaggtctctaagacctactttgtgaatctggtgctcctgtattgggtgcatatatatttaggatagttagctcttcttgttgcgttgatctttttaccattatgtaatgcccttctttgtctttttggatctttgttggtttaaagtctgttttctcagagactaggattgcaacccctgcttttctttgctttccatttgcttggtaaatattcctccatccctttattttgagcctatgtgtgtctttgcatgtgagatgggtctcctgaatagagcacactgatgtgtcttgactctttatccaatttgccagtatgtgtcttttaattggggcatttagcacatttacatttaaggttaatatcattatgtatgaatttgatcttgtcattatgatgctagctggttattttgcccattagttgatgcagtttcttcacagtgttgatagtctttacatttttgtttgtttgtggagtggctggtaccagtttttcctttgcatatttagtacttccttcaggagctattgtaaggtaggcctggtggtgacaaaatctctaggcattttcttgtctgtaaagtattttatttctccttcacttatgaagcttaatttggctggatatgaaattctgggttgaaaattgttttctttaagaatgttgaatattggccccactctcttctggcttgtagggtttctgcagagagatctgctgttagtctgatgggctttcctttgtgggtaacctgatctttctctctggctgcccttaacatttttcccttcatttcaaccttggtcagtctgacgattatgtgtgttggggttgctcttcttgaggagtatcttagttgtgttgtctgtatttcctgaatttgaatgttggcctgtcttgctaggttggggaagttctcctggataatatcctgaaatgtattttccaacttggttccattctccccgtcactttcaggtacaccaatcaaacataggtttggtcttttcacatagtcccatatttcttagaggctttgttcgttccttttcattcttttttttcctaatcttgtcttcatgctttatttcattaagttgatcttcaatctctgatatcttttcttctgcttgatcgatttgtctgttgacacttgtttatgcttcatgaagttcttgtactgtgtttttcagctccatcaggtcatttatgttcttctctaaactatttattctagttagcagtttttgtaacattttttcaaggttcttagcttccttgtattgggttagaacatgctcctttagctcggagaaatttgttattacccaccttctcaagcctacttctttcaattcatcaactcattctctgtccagttttgttcccttgctggtgaggagttgtgaccctctggaggagaagaagcattctggtttttggaattttcagcctttttgcacttgtttttcctcatcttcatggatttgtctacctttggtctttcatgttggtgactttcgggtggggtttttgagtggtcatcctttttgttgatgttgatactattgcttcctgttttttacttttccttctaacagtcagtcccctcttctgcaggtctgctggcatttgctggaggtccactccagaacctgtttgcctgggtatcaccagcggaggctgcagaacagcaaagatagctgcctgcttcttcctctggaagcttcatcccagaggggcacctgccagatgccagctggagctctcctctatgaggtttctgtcaacccctgctgggaggtctgtccccagcaggaggcacaggggtcagggacctacttgaggaggcagtctgtcccttagcagagcttgagcactgtgctgggagatctgctgctgtcttcagagctggcaggcaggaaaatttaagtatgctgaagctgtgcccacagctgccccttcgccaaggtgctctgtcccagggagatgggagttttatctattagcccgtgactggggctgctgcctttctttcagagatgccctatcctgagaggaggaatctggagaggcagtctggctacagtggctttgaggcgcagagatgggctccactcagtccgaacttcccggtggctttttttacactgtgaggggaaaaccgcctactcaagcctcagtaatggtggatgcccatcaccccaccaagctcgaacataccaggttgacttcagactgctgtgctggcagcgagaatttcaagccagtggatcttaccttgttgggctccctggaggtgggatacactgagcaagacaactcggctctctggcttcagccccctttccaggggagtgaatggttctgtcttgctggcattccaggtgccactggggtacaaaaaaacaaaacaaaacaaaacaaaaaaacaaaactgcagctaggtaggtgtcttcccaaatggccacccagttttgtgcttaaaacccagggccctggtggtgtaggcacccaagggaatctcctggtctgtaggttgtgaagactgtgggaaaagcatagtacctggcccagaatgcactgttcctcacggcacagtccctcatggcttcccttggctatgggagggagtttcctgacccctggcacttctcaggtgaggcaacaccccaccctcctttgtcttgccctctgttggttgcacccactgtctaaccagtcccaatgagatgagctagatacctcagttggaaatgcagaaatcacctgccttctgcattggtctcgctgggagctgcagactggagctgttcctattcagccatcttgcccgggaatttgtcaaactgattcttaaggaacttaactacctccaaaacaacactctttaaaggaagacaacaagatccaaatacaatatattagtgttcttcaaagaagcagagctgatttgtgtgtgtgtgtgtgtgtaatgtgtgtttgtgtgtatggagagagaaacagagagagacttattatgcctagaagtgtgaaatatgcagaacccttggtcccgttcgagtccaaaggccgcatactgctatagaaccagaaagagcttatgtcccagttcaaaggctgtcaggcaggaatattttctcttacttgggagagggttgggctttttttctgttcagacctttaagtgattgaatgagacctactcacattatggagggcaatctgctttactcagtttactgatttaaatcttaatctcatccaaaaacactctcatagaaacacccagactaatgtttggccaaatatctgggcacccagtggcccagtcaagtagacacaaaaaaattagcaaccacatttaacaatgtaacatttataattttcacctctaataaaatattactagacatacaaagaaaaagaaaaatatgacccataaccagtgaaataagtcaatagaagcagaagcagaaataaaaataatattagaaatagaagacaaaaaccttaatatagctattataaacgtgcttgggctttaaagtaaaacataaatttaataaagaaatggaaactataaaaaagaaccaaatggaacttctggagttgaaaaatacaagatctgaaattaaaaatgcgatagatagtcttaacagtagattaaagatgcagaagatgtgataagtggacttgaagtaagaataatagaaaccataaaaaaaaaatagtacaaagaaagagagaaaaaaaggctgagaaaaaaagcctagagcttctatgacccgtggataatacaaaatgttctaatatagtgagactgaagcccaagtaaaagaggaacgggacaaatatttaaagaatgatgcctgaaactcatccaaatttgatgaatactataaatctacaaattcaagaagaataaacacagagtaaaccataccaaggtacaacataatcaattgctgaaaacaaaattaatgagaaaatcttaagtgcaaggagacatgggggaagacatattaaataaaaaggaatatggataagagttatcactgactccttaatagaaacaatacaagccatctttgaaatgccaaagggggaaaaaaacccctgttcacatagcatctatattaagtgacaatctctttcacaaatgaagcaaaataaagatattttctgcctaacaaaagcaaaaaatattgttacaaggagacctgcatatcagaaagtttaaaaaatattcttcattttgaaggaaaatgatatcagatggaaacgaatctattcaaagaaatgaaaagcactgaaagtggtagatctgtaggcaaatatgatatttgttctcattaaaattttttacatgataattaaaaaattaagaacaatatatggcattataacaaatgtatcagtgaaatgaatgaaaatgatagcacagtgatggaagggacgaatggaatttatagtgtttaaagttttcatactacacttaatgatatattatttgaagattggctgtgattagttgatgcatattttaaacactagcaaagtcgctttaaaaaggaggtatgttgtttagtagaggagacaaaatagaacattaacaaatacttaatcaaacgaaaaagaagaaaaaaggataaagaatggattagaaggacgggcatggtggctcacgcctgtaatcccagcactttgggaggccaaggtgggcggatcacaaggtcaggagttcgaaaccagcctgaccaacatagtgaaaccccatctctactaaaaatacaaaaaaattagccaggtgtggtggcgcatgcctgtaatcccagctactcaggaggctgaggcaggataatcacttgaacctgggagacagaggttgctgtgagccaagatcatgccattgcactccagcctgggcaataagagtgaaactccatccccaccccccctaaaaaaagaatggattagaaaacaacaaatagcaaggtgatagattcaaacctagccatattgataataaaattaaatgtaaattatctaaatactccaattaaaaggcagagattatcaaaatggatttaagaaaaataagacccaaatacatgttacctagaagaaaagcactataaatatgagaataaatactttggaagtaaaagacataccctgcaaacactaagcaagggacagctcggccgggtgtggtagctcacgcgggtaatcctgacactttgagagtccaaggcaggtggattgcctgttcgagaccaacctgggcaacacagtgaaacaccatctctactaaaacacaaaaagttagcctggtgtggtggcgggctcctgtaatcccagctattcgggaggctgagacaggagaatcacttgatcccaggaggcagaggttgcagagagccaacattgtgccattgcactccagcctgggtgacagagcaagactccgtctcaaaaaaaaaaaaaaaaaaaaaaaaaaaaggaaacagttgaattgcctatattagtattacacaaagcagccttcaggacaaggaatattaccagagatgaagacaacctttccttaattataagagtcaattcatctagaaggcaaaacaaacctaatgtgtgtgcacctaaacacagagatttaagacatattaagcaaaaactggcagaactgaaaaaaagatgattcaacaattatatctggagatttcaacacttctcagtaactgatagaacaagagagaaaatcagaaaggatttagaagacttgaacgtcaccacaaccaatttgacctatttcacatttagagaagactacacccaacaatgatatgacacacatccctttcaagtgcataaggaactttcctgtggttaggtatatactgggtcataaaacaagtcttgataagctttaaaagactgaaattacatatagtatatgagcataacagaattaaattagaaatcaattaaaaatatgtggaaaatatctgaatattcaaaaatagaacaagatatttctaaataatccacagatcaaagaagaaatctcagaggaaatctcaaaggaaatcagaatttttttgaattgaatgacaacgaaaacataaaataccaaaatttgtaggctgtagttaaaacagtgcttacagggaaattgataacattaaatactcacattagaaaataacatagagttttgatcattacaccctccattcatataacaaaatgttacatataactcataaatatgtaaaatattgtatatcagaaaaaaatagagctttaaattaatatgttgcaccttaacaaactaggcaaagaagggaaaatatgcacaacattttgcatgtaatttcttgtgatcctggaaccctctgaaacctatcatgaactgccggttaagaatccctgatcccaggcctggcacggtggctcacacctgtaatcccagcagtttgggaggcctaggtgggaggatcacgaggtcaggagatcaagaccatcttggccaacatggtgaaatcctgtctctgctaaaatatgaaaaatcatccaggtgtagtggcccatgcctgtaatcccagctacttgggaggctgacacaggtgaattgtttgaacccgggaggcagaggttgcagtgagctgagatcacgccactgcactccagcctgatgacagagcaagagtctgtcaaaaaaaaaaaaaaaaaaaaaaatccctgatccctaatgattaatcccaaatttgtatccccatcccagacctcagtcctgagctccagaattttaggttgaaatgctttcaggacatctacagttaaacagttcacagacacctaaaaattaaaacttccaaaacatagtgaactaactcctcctcctgtttcctttcttcccatatctcttcttccttgtctcaacctataccaaggaactatgtgaccacccgcttagctgcccatattgaaatcctgggcatcttctctttccctcactcacgcatatagtcaatccctaaatcctgctttttttttttttttttcaacacctaaaacctctcacagccacctgtttttctccatcctgttgctgttgtcatcaagtaggtcatgaacatttcctgggtagatctgtgaacagcttcctaactcatccctcctctccctcacctctggttgctctttctgtatatccactttcacaaggcagtgaggatgacatttcaaaatgggctaatatgatcttgacatgtcttcattgatgacctttatctagctttgctgtgtccttgggattgattccagtgtctctaacatggcttataagacccttcatgattgggaccctattcatcccgagtcttctcctcatgttctgctcttaactttatgttcactgataatgaattatttctgtttctctccgtttcatgctttgctctttcttttaggccttcacagatgctgttccttttgtctggaatatttttcctgacccctttccctttataccctcatccccactcccccccaccccaccctcactttatcgaatcattcctattcagcctgtagacctaatttagctgtgatttctctgtcaggacttcccagatcttccttctgcggcttccctgtctcctcctccagtgagttagtgtccctgctgagaatctcattgcattttatcattctgaattggaatttctgaattgtgtgtcttccccactcaactctaaatataatgtttatccttgcagatattgtggtgccttatattttgacaacctttggccatataaggattctggaattactaattacctgggaaaatacatgaaaactataatgtaaataaagcaaaaccggtagacattcaataaatatgtaatttatgtgcttgtgattaaatagtgtatttcactgtcataacctattctcctataaattttttgtctattctgttgacaaggaaagtataattatttgttttgttaataagcattgggctgtattggacagattatgagaaatattaaatgttatagttttctcttatttttctatatatttgattatcttttcctttccttgagaggaattctgagcatagaattatagatatttgcttgagaatctgtgatgtattcagtttagcatcccaaatgaatgcaaaattgatgagcttttgaatgtgctaagtcattttgcctgctttttatttttgcattattaagttgtcattgcctgttctcttttgtccttttactctgcacatccaaatgttcagtcctaaaattataccatgccatcaccaaatgtccagcaccagatccttattaggagaataacagatccgctagagattagaaggggtcagtatgcccttttggcgtgactctcatacactgtactctacttcggtagaaaaacaaaatcattaaaataacgtcacacatgaatactcattaaaccatgttataaactttcagttcatttcaccaggtctgagattcagtttatctgttcatcaggtgatgcagataaaagtggcaaagaattttgggggtatttaaagaaataacctatagttatgtgctcctaattttagctacctgtataatatagtaggagaaaaatcaatagaaaagtaaatgtggtcaagtgtaactgaacaatattggtgtcagccctgaccataaatatagcacatttagaagtgttctaagcataaccaagccaattattgtgtcagccctaactctggagctacaaggagaaaaagaagtatcattcatatggaaaaagaattggatccaggcatacggatatcttataggtatttgatgttccacagaaaaaataacctaagagactattatcaagagattaaagctttaaatttaatagatctgttggcttcccccccccccccatttgagtcagtggttaggttattgatgtcattcattcatttattcactcatcaaactcttattcacccagtgcatggcatgcacagtgctgctggggctccagacatacatagcacacaatccgtgacatcaagcaggaagaactaaaggcagagactgtgggtgctctatgtgcatatatgcttctctctgaggaaatttaggtcatgctctccggcctccacttgaagtgaacctctaccctgtccctctccctggattcctgtggaaatgttagaggaatactcaaggcaactgtagctgccccaatttggatgcttcctgttaaaatattcagaggattccatgttattttccccaaataaatattctaagtaaatgtaggtttcatttacttagggttattttccccaaataaatattctaagtaaatgtaggtttcatttactcagggttattttccccaaataaatattctaagtaaatgtaggtttacattgatcttttacttaatttagaaagaaccttcaacggtgcattacatttgttgctatgtaatgtcaaggattactatcattgtgattggtgccatctgcaataaatgcagaggaagaagcacatagcagggctgaagatttagagcctctctcccagtggacacgagcttatgttaggacatgcctctaaattggtatgactcacatggcaagaggatagatttctctgtgccttttatattttgttttgttccttaaaagttttttttctttttcttcccctggggatagaaatatgttttttccatttttacaggcaaaccacttcaatagaacatggctggcggccatatggacatatttgaatccaacaattaattcagcaaagaaagctgcttgtggcaagttttgaatgtgccattccaggtagtgctttgatgataaatgaggagaagattgcaaagaaaatgacagcaacatttataaaagggtatgtttcctttattcatttaatgatattcaaattattagttgttgtctatttaatgtgaagtctatggcacttgaaggaggtacttaacactttctatgtataattttacggcaaaaaatatggtgttaattttcaaggcacttacaatctagcaaactttggaatgagtaaatgtattacccttatctgaaactcctaagtctagacttttggctggcatggcttccagaactggctttatgatggtatttcagaaccagcacttccagccaaaaccaataagtgtggagtggctcaaagacggaaattaccaaaccaaaccaaaacagaaacccctcaaaacagaaaaacaagctcacgttaacgaaacacattagaatctcataaaggactattaggaatatctaggaaaccactcattgtttttgttttatttcactaggttttgtctcaaggttgtcctatccctggatgatcccttcagctctaacatttgcagaatcaaagctttagcttccagtcatcactcttcacatgcagggagcacacatggtgtgtggctaggatcctttccctttagaattccttggcatcaagagtagataaaaggggaaataaaagtatcaggatattatgtgggtttcatgtacattttactgaaagataactgtttaacctccatccagggaaatgaaatactccatggccatccaaagacctgagaagtatacattaacaattctgtgaacactggattaaatatttcctctgaaaaaatctatagcagcttatttttgtctaattttatcagctacttttaataatgttaccacttaaacacttagatatttattgcgtgtaccataaaaatatcaattagttgagtttctgaactgaaacatgtggtcagatacccaaattataatttaattcaaattaataagacattgcaaatatggtgatagttgcaactatccacaatatcccaaagggtctgacttctggagggagatataaactccctccagagcattttatagaggtaatgtttatatttcccttcagaagttgaacctattgggatattgtgtttatattttcagtttcagccactattatcccaatatgcacactgcacttcacttagatgaagcataaaggatatcttccccattcttttcattgaatgagaatagaattattggatatgacttttaaaaattactaaaacgtataaaataatggcactacatatttccatatttaaagtgtgacagagaactgcaggcagtagtgttgtgcaattatgagaatagacagcaaagaactgaaatgttgcccggcattgtttatttttgaaagctttatgtatacaccaggaatgcaaagaagtacaaatcctgggaaagggttaagtgatgggaccatcagctctgcaaggctgtggtgcatgaatctcttgactttcaaacagtttggtagggtatggctctttcaatgtgtagaagtcatgacacaatgcaggaagtttattgaaacctttgtactgctatatttagcctgacatccagtgttctaggctagttacaagacagtgtgatctccttacagaataccaaaatgaactatttacactaaaggaaagtagtttaggaatgtttcagagaagaattaaatatggggtaaatattatcttcattcctttgcaaaaacctgttttatactagttatttcattttactttgaatttggattcatgcttaggggaaaatagttagattttatgttccaaacataattaattgttatggttacagtaaaatgaaaatcataatgggaagaatttgcaatatggaagaaaatcacccaccattatgtagccttaatcagatttaaaaatttaggctcactttttgatttgttgcttagagcataaccccttaatccctttatgggtactttttgtcacatataaaatggagaaagtaataattacaacctgcttttgaggctccttggaagatgaatacaatgaaaagtagaaaaatcaatctttattattattatgtttgagacgctggcagaacagtgtgattccaacatgatatctaattacagccaaaatttttcaggaggcagtagctaattttgcacatcttctttaattgccacattttcatgggaacttacatggcaattgattagaagtcaaggttttaaaggtatgaagaaacattatctttcacatgccatcagcatgatctgtcaaaaatacagtttgccattttacttcagtgttaaaaattcctcagtgatttctccattgaattcaagatgagcataatatgcacagtattgcataatgcagatctgatcaacttttttcagtttcagtcgccatcatcccaatatacacactgcactttactttcaccaaacttcatagagcgccctgaccgcaccaagctctcctgaactttcttgccttcacttgtatttttccctctgccggatgtgccatatcctcattactgcccccaccaacatagtgtaatcttctcagtttgaaaattaagcttatatcacctcctctacatacctgtttctgaccttgccgttgcctgaagacaatgctgtatttgtttaatatgactctctcccaaacacactgtgggctccttaagtgtagtctctctgttctttctacctttatatccccagagcctagctcagtgtttgctgactgaataagtgaataaaagaatgaaactctgatatgaactgtataatgtctctctagaagcatctggaatttgtcattaataataaattaagttgctttaatcttccagagtttggaactaattgagagatgggaccaagaaacaggcatgtcaaaatcaaaatgacagctttgttacagttaataaaggcttggttgggggacatgacttatgtggttataagacatttcctagtggaacccaagaattgggcacaagaccttctcagtcaaggcagttctgaacaaccacaggccaccttcctatttaggtatagagtcttgaccactaagtctgtgacatgagcaagagtagatcagaacatctgcatgtggtcagatcctaaagagaatgaggaaaaatgctgatccaggcctgtttactttctactccaaacccatcagttagttaattctatccttttcccttaggaaacaattggcataggggcagataagctagaagtgttctttgaatgaatctcttactgtaggggaacagtaaattaggggaatgtaagctcccctggttgccttcctatagcacttccaacagttctcttttcatatgtcctttccctggcaatagtactgtgctttccccagctagcagagcataattacagagccagtgttacagttgatagttcatcctctctggtgagcaactggcagagatcatccacctgtagtctcagacttataatgaattgttggtatcttatatttcaatttttaaatataaaactaatacctgataaccttaaaaattacaagtgattcagatacataaaagtaagcttccctaaaactttttctctcttccaaccttctcccctgggtggtgataactattgtttatgtatgtatctccagactttaaaaatagccatttatgaatgtttaggcataaacatttttgaaatcacaagtacttgataactgatagacactttcccacctcaatttatatgcttaactcattctttttggcataccatagtatgaatgtttcatattcccccctattctctggatacttaggttgtttccaatttttcactacacaaagaataaagattctgtacaaccatctctcttactatttctgtaggagaaattcttataagtaaaagctgagtcaagtaatttgtacatcataattctgatggatattgctgcattgtgctttcaaagtctatactaacaatatatcaagttcccatttcctgaaacttatggatcctggatatcataaagctttcaagtttttgccaatctagtggtggaaacatatcttattgtttaaatttccatttccttttttacttatgatattaaacatgattctgtatcgttagcagtctttggtacttcctcttctgccagttcataacttttgcccaatttcctttggtaatttaagtttttatatattataaattttaaatctgtatctgctatgtggcaaataattttttttccatcattctaatccatttatttatttttattttattttattattattacactttaaattttagggtacatgtgcacaatgtgcaggttagttacatatgtatacatgtgccatgctggtgtgctgcacccactaactcgtcatttagcattaggtatatctcctaatgctatccctcccccctccccccatcccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaattcatcattttttatggctgcttagtattccatggtgtatatgtgccacattttcttaatccagtctatcattgttggacatttgggttggttccaagtctttgctattgtgaatagtgccacaataaacatacgtgtgtatgtgtctttatagcggcatgatttatagtcctttgggtatatacccagtaatgggatggctgggtcaaatggtatttctagttccagatccctgaggaatcaccacacggacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatggtgagcattttttcatgtggtttttggctgcataaatgtcttcttttgagaagtgtctgttcatatcctttgcccactttttgatggggttgtttttttcttgtaaatttgtttgagttctttgtagattctggatattagccctttgtcagatgagtaggtggcaaaaattttctcccattttgtaggttgcctgttcactctgatggtagtttcttttgctgtgcagaagctctttagtttaattagatcccatttgtcaattttggcttctgttgccattgcttttggtgttttagatatgaagtccttgcccatgcctatgtcctgaatggtaattcctaggttttcttctagggtttttatggttttagatctaacgtttaagtctttaatccatcttgaattaatttttgtataaggtgtaaggaagggatccagtttcagctttctacatatggctagccagttttcccagcaccatttattaaatagggaatcctttccccattgcttgtttttgccaggtttgtcaaagatcagatagttgtagatatgcggcgttatttctgagggctctgtggatacaaaatcaatgtacaaaaatcacaagcattcttatacaccaatagcagacaaacagagagccaaatcatgagtgaactcccattcacaattgcttcaaagagaataaaatacctaggaatccaacttacaagggatgtgaaggacctcttcaaggagaactacaaaccactgctcaatgaagtaaaagaggatacaaacaaatggaagaacattccatgctcatgggtaggaagaatcaatatcgtggccatactgcccaaggtaatttatagattcaatgccatccccatcaagctaccaatgactttcttcacagaattggaaaaaactactttaaagttcatatggaaccaaaaaaagagcccacatcgccaagtcaatcttaagccaaaagaacaaagctggaggcatcacgctacctgacttcaaactataatacaaggctacagtaaccaaaacagcatggtactggcaaataattttttacagaagtggctttcttttcactttgtttaatagttcatctttttgcttacagattttagtgtcaacattttcatagcctaaattcctatgccaacatcactgtattttgtgtgtttttattttgttcccttgacctatttgtgtattctttgtattagtttaactgtgtaatagccacctttaataaaaatctctaatatttattgagtctctaatatgtattaaacactattctttttttcacaactacttatgcagtaattaatactattatcaccattttacatatcaggaaactgagacccaaagaggttaagtaacttgctcaggttactgggctaagcaagcagctgagctgagatggagccccagcattactgaaccaaggtcagtgctggtaagcactataccacaattgctttccacaggtttatagaataacttgaaatttgaggtggctcatggctgtaatcccagcattttgggatgccgaggcaggctgatcacctgaggtcaggagttcgagaccaacctggccaacatggtgaaaccctgtctctactaaaaatacaaaaattaactgggcgtgggggcacgcacctgtggtcccaggtactcaggcggctgaggcaggagaatcacttgaaactgggaggcagaggttgcagtgagctgagatcatgccactgcactctagcctgggcaacagagtgagactctgtctcaaaaaaagtaaaataaagtaaaaataaataaataaataaataaataagaatgctttgaaattctgtgagcaagttgagcctcagtgttcttctatctcatactttttttatgcatttacttttatgagtaagttttataattatcttagatttcaagatagttctgttgcgatttcactaattgcttcaacattttatattattttgagaaagaaatgtcattgttatgaactgcatcgttttccacaatatcccaaatttttatgttgaagtcctaactcccagtacctcagaatgtgactgtatttgaagacagggcttttaaaggagtaattaaaatgaggtaattagggtgagccctaatccaatgggacattagtccttctaagaagataaaatttagacataagtaggtacagaggaaagaccaagtgaagacacagagagatgatggccatctacaaaccaaggagagagcctcagaagaaactccccttgctgataccttgatcttagacttctgcctccagaactgtgagaaaataaatttgtattgtttaatcctccccattctgtggtactttgttatggcaaccctagcaaatgaatatagccatcgtcacattttagtgttttcccatgtaggaaagtgttggctttttacttactcaggcctttcctaggttctttagtttaagtgttttcttcaagtacacgttaatatttcttgttaaccttgtctttattcattgctttttgtttttcttgtgatttagatgttttttcttacatatatatgaatatatgtacacacacataggtacacacacacacacacatatttttagagaagtgtctgactctatcatctaggcgacagtgcagtggcattatcatagcttctcataaccttgaactcctgggctcaagcgatcctcccacctcagcctctcaagtagtagtagtaggcatttatcactacacctagctaatttttgttttcccttatgtttataattgatcattgattttgtatatttatattttatctggctaccttactgtaccttcttattagttttagcagtttttcaagtgattgtcttggagattttaggcaggcaaatatatataatatgcagataaaggcagttttgctttgtttctttccttccagtacatacatttcacttttattttaatgcattgacaggaatgctccaggattagcttgaaaaacaataaagatagtgagcatacttgcctagctcatgatcttatttgctgatgcttaactatggtatttgtaacaggttttgacataattttcaagtttttagaacttttccagggctctttattctcttcttatcagcaataggaattgtaggaactgctttaccagcagcttataaaataattttatgggtttttctctttttatatattaatagagtgaattacatggctagatttctaaatttaaatcatctttagtttccaaaaataaacctgtttgttcattgtgtgttcttcttaaaatttgctactgggttggaattattaacattttattcatgaatttttttttagaaagtgtgtgcctgtgggttcaatttttcaagtcattgtatgactgaaggtgattttttcctgttaatttgaattataatttagctgggtatagaattgtaagtttaaaataactcattatattctgatatccactgctgtagatgaggaatcagaggccagtctaatcctctcagctaaaaaatacttaagaaaaacctcatttgatatgtatcacagcaaaaatggattagatgtttttgagattccatataaactattttgttgtgtcttatttatttatatatttatttatttaattaatttagtttttgagacagaatttctctctcgtgcccaggctggagtgtattggggcaatcttggcttattgcaacctctgcctcccaggttcaagcgattctcttgcctcagcctcccaagtacctgggactacaggcttgtgccaccacgtgcgactaatttttgtatttttagtagagacagagtttcaccatgttgcccaggctggtcccgaactcctgagctcaactgatccatccaccttggcctccgaaagtgctgggattacaggcatgagccactgtgcccggtcttgtttttgtgtttttatgttctattattttcattgtaatatgttcttactagatatggtaaagtgagaaaactaaatttcatctttttattccatcagtataatttaataagtgagcactaaagtcagacataaattataaataagaaattcttactactaaatgggaagcaggttaaggaataaaccactttgtcaatagcagaagtaagaacataagccaggtgtctgaattataagatgtttggaattcttctttggaaagggtttgctattacaagaaaaacttggaccttttgctcaaatgataaagggaccttggcagttgtttaaatctctaggggcaaagccaccctaaaatgcacagttactctgagatttgtttgttctctctattgatctgctaggcttgggattttcaactattaaaaatattaagctctcttaaaaatcattatctacctatatttgagtggtatgtatgtagtatatatgaacacacacacacacacacacacacacacacacacacaaactctggagtctctattccttcccagtgatacttaacttatttacactacaaactcaatttttctgtttattttccatatttttgctaccaatctctttgggagttatctgttggctgtgaatttactgaatttgaaactgagattatacccaataaggatttttatttatgaattaattggtttctggagttttcaaataaagcacgaatctgatggtcatattgcaagttgccctgcaggtcttcctgcaaaagaaatgtgatgatttaaagggatgatgcctgttggatgaaattggccatttcaaaattcttcccctcatgtgtcatcttatttcagttgttattatattcagagccttgcatgtccacttaatagcactgtgcagaaaaacatttccaagtaaacacagtaatgttcatcatttgtttcttaggagagtcaaagtgactaatttaagtaatagaaatacataattatagggagagaaaagttttcttttgctactttagtataattaataacagaatgagtagcatcacataaaaaattaaagataaaaatggcacataggttttattacttttaaaatatatttattgaatgatctagacctattcttcatttaactgacactgaatagggtcatttaggtataagatgaactgtcatctttttggatttgtaaaatcagtatccattgggggaagatctttttagaatgtatgtaagtatattacagttctgctattactgggccatcagatgcaatttggcacagcatgatgtttccacagttgctccaagttaacagtgattgtagaacccttagtgattggctaaggttatttttaaacctaattctagataactcagagaagtgctgttctatattccacatggtaatctcagcaacatttggcatcgaggatttattgcataccataactctggcttcactgtgaatctcttttaccatcaaaacactgaaaatagaacctcgaagcaaagggacggccatgctatttttcattagaaagatcacaccttatgcattcaggagttctctgttgcatgatataatttgtttgcttacttgtttattgaggaaaacgtctttgcatccgtgaagctttgatgtaattgaccacctccatctcagatgttaggttctgtcgttgttgaaaccaccctatgtgtaagtttctgggaaattcttgggagaactctgtattcgtttaacttgatgacaaaacagcaacatgctaaataatgtgattaaagttgttaaaagccaaaataaacacttataattatctcaagaaaaacggtgtcaggcaagtgcaggctctataaagcgggactccgtgtgcgtctttcaggtcctgctgcacaatagatcatagttaaaggtctgttaacagacctctgacggctgagctgggtagcttgtggtttccttcgaaacctattggcataatgtgaatttatgtgtgaggtgcaaattggaagttaccttctactggtgcccttggcagaacagaaatcatactgtagggctagcagcaggaagtacatggctttgaaattacccagcagggtttctgctcgctgcccttgttgcttctgagacaggggccttatattgtctggtcatgattaaaatcaaagtgtaggcttctttgctgggtgccagtaaacttaggtgaaaagcagaaacaatctgggattttaattattttaaaatgcaatgtgggcaacaaaagaagatgaaagcatttttgactaatctatgccaattattccacataaacggatttgccaaaaaagaggcccgtagagagagagtaagcttgcctttacaagagacttcataacatatctcacagctataaaatagatctgtggcacgtatgctgttcttctgaaattcattgagaaaagtgcctgaacattatgatacttctgggtgagtagagaaagacagatgtgctttttaccttattccaaatacaagatgctacatatttatgaaataagcctttaaagcatggaagataatttcctggttaataacttactgacttaaagtagtccatctaaaaggcgatatcttggtgttatgcttaagatttgcctcattccacagtcaggttggacggatacttcccattgtgctataattcccagaggtggcagagttggatcttctctcttcaacttctttttccatgaagagtataaagagatgagtcatagggtcagagttctctgtctctaataatttgggaggaagtcaataataaataagatatagggagtgcaaacttagcatcatattgtaccaaccagtaattaaataaacagtagtcacaaccagaagttaatatgtaggtttgtttgttttttaaaaaagcacccagtgtataagtggtgggagtttatgcattaagttaacgaatatttattaagtgcttgatatgtggtaggcactgtgataaagactggggatataaaggtagaccagattttcaaggaagatagagaaataaacaattatttacacctgttactctggagactgacaagggccaagctaaggaagtacatgtgctgaggtggtaacctgtggttattacctaccccacagctggtgctcagccacaaagagagatgtgaatattacatttctatcacaattggcatatatggatttttttaaagacataagaagaggaaaaatctattgctttgattgaaagattggatgtgtttttaggaaaattgagtagggaggtccatttctttcctttgaaaatttatttgcggtcaatttattatgatacttcaaaccatttagccatagcaaagagcaggtgtgtagaaactctacaaaacctcgacgaatcctgtggtcccctgaaaaaggcctgtgtcttatctgatgaacactgctcaggctcaagtctcttgagcgtcaaaactgctcaagcaagggggaaatccagattttatatctccttccacttgaatttctggataagaatgagagaaatccgcaaaatccagttacgttaaatagcttttacgagtatctttttggaatgctgtcagttgtaacttcgttttgtctgccaggtataagcatggaagattcaagctgctcctggctgtaagaagttaatgtggaattttgctgcttgaaatttaaattgggctacaaaaattagctcccactggtggaaacaactttctttttagtatgagaagttgtttgaagcttttttctcccccaaagtctcatcgtgatcaggctttaatattgctctcaaaccaacctttaatttaataagcagagtaattttgttcaggaaaattttccatgacatttgttgaattaaatgtacatactcagtattccatcccagcagcaccacctattgttgtcttgtagcttttctactaaacttcacaagaatctaattcactcatttctctgagtatctctgtgagatattcaacatacattttacaggttataagggttaagcattccagttgtgttgtggtgatgtttctaaagtcataaatctgtaaataaaatgaatgcaggatggtagacttttaattggtgaaaggacactgaatagagaggcaaaatgctttaaaatatttatggatattaaacaatgtttggaaaataagattcaagttatacctgtatgttttaaaagttctactcactacacactatgattctacaattaacagcagaattgtattggaataagataagaaagactaaatgatattattttgtgccaattgttattgtaattagaatattatgtattgatttattaaatataagtggctttttttccagcgaggttttaaaatccacttataataaaaacataggatttgcatttacaggtagaaaatgaaaatcggtaagtgtcaagatggggtccactatgtaattttttcagcattatttccagaagagaggtaggattgggaattttagtctttatttgatatttacatatacttatatgaacgtgagtcattgcctgtgttttctgtaagccatctttacttcaaccatgtaaaccatacgaagcattttaggaagaatgtaataagcaccatatggagatggagtattttcacacctgttatgtcatttgatcttccctgcaattctctaaggtaggtaaggtggctttgggtccttggcctcttcttttctcactatgcacattcttgaaatttcatccacttctatagattcaattaccatctctacacagatcatttcaaaatttgtacctatgttccttacatctctcccaacctctagaaaaaaatgtatacatttggaacttccacaagcatctaaaactcagcacaaacttgtttcctgccaaaacgacgcatcttcctatactccttatcttaatgaatgccctaccgtctgcctagttgcccaagccagggacctagaagttatcttagactctcgccttttgcttgtcctcttcactcactcagttaagactattacatttcctcagtatctctgaattccaccctattttgttcaggccctatcatttctcacctggctcattataatacctcttacaactactaatttgacattctctgctgctagagagacctttctaaaatttaagactcttagtaaaatacttcatgggtggtttctcattacttttatgatgaagtacaaatttttacacaaataatatgatgccatttaaaatatatgacccatgacaaatttcccagtttcctatcttacctctccctgatcatactcgttgttcttaccaaatagatgtttcattctcccaacgtggcagtcctaagggtgattccttatttgaaaatctattaataaaagtcatcttatgattagaaatcaggagccaaatcctataatcatctacatagatgctgaatgacatttaaaaaaaattaatacccattcatgttaaaaacaacaaattaggaattgatagagaatttaatatgatagtacacataaccatcagaccaaaatgaacatcttaactgatgaggaacataaagtcaagaccaagaaaggacagtgggtatctcaattgttatttagctttgaattggaagtattagccaatgtcattagataagagaaattggaggcatgagcattggaaatgaagagattaaactacctctgttgcagatgttatgattatatatcttgaaaacaaaaaaaaactgtgaaaaactacaaataggagaatttaataaaatagcaagatatgtaactaacataaaatcaatagtttttgtgggaaatcaatagtcttactatttgtatataatggagaagcagactccatacatgataacaaataaaatagaataaaaggaaaaaagcaaaataaaattcctaggcataaaactaatacaaatgtttaaaacctatatgaggaaaactatagacatgcctgaaagacataaatatgtccttaaatagaaagatataaaattagtcacggcaagctgactcagcctcagaaacatgttaattcttcctaaattagttattcatttaattcaattccaataaaaatagcagaagtttttcccctctggagctacacaaattggttataaagttcatatggaagaataaacacgcaataccaatcaggaaattttgtaagaagagaagcaatgtatttctttttctaaaatatattaaaaagcctctataattaaaaggttgtggtatgggcacatgagtagacagaaagaccaatggaaccacacagaaaatctggtaaagcagctaacatacaatattgataaagataacctctgataatagagggaaagtatgttcttaatcagtaaatggctttggaacacctggataaccatatgaaaaaaagataaaattacatccatttatcacaccatatggtagatatccaaatggatcagagatctaaatgcatgaaatatttcaggagcaataaggaaaaaagtgataaatttgacacagagtaatattctgaacacataaaatgcttcaaagaattgagaaaaaaggcaaaaccttagagaaaatggggaaaaaatacagatagttctcagaaaaagaaataaaaatgaccctcacacatagaaaaatatactgaatatatgagaaatgcaaattaaaactacactgagataacacttctcacccacctgactggcagagatcccaaaatttgtaaactatactctgttgtagaggttttgatgaaataagtatgcaaagtggtatcagcttcaatgggtttgggggtgggaggatttagcattattgagcaaaactgcatatacatttacccttcaatcctgcaacatgaattctaggaatctgttccaaaaatgcaaagtgacatatggtcaagactgttcctcatagaattacttataatactaaaagatgaaatagcttaaatatcgataagagactggttcaataaactagagaacattgacacatggaacacaggcccttttttgcttaacaaaggtgtctgaaatgcttgttattttcattatattaaaaggagtcattagaatggttatctatcaacctaaagcctcaaccaatttcctaaaacacagtgaataacatatatgtaataaatgatcatgtaaagatgtaaaatgcctaaaaaatccacctcttaataaccaattactgtggttgttaacagtcaccttatatggcgacttccggggaaagtgccttttcttaccttcagcagcagccttcctgaagcatatgcccttttgaaagtccatgtaggctttgccattttgacaactgtgtatggagactcaagactttatctgacatcattttgtttaaaaagttgtattgaggtttgaggacacgaatatgtattctacctgtattaactggccaaaaaataaagttgtattggagaggtgtctgtgggtttgaatgctaaaacttacagtttgggatactaaaaatcgaaaggtagaaaatattaatgggggatgttctgcagggcatatggtatgattcatcatagaatagaatcagagagatttctgcatgctccttttgaatgacattcagaattcatctttaatggaaaaaagtaaggtacagaacagagtgtagaagcgtgtagagtgagctactttttgtgtaacagagggtcaaggagtgataaaagtgtatagcattttcttacgttttcaaaagaattagcatgaggttacctataaggcagggatgactttggagctatgtaatgttttacataactgttttacataactgacaatcaaaatgaaaatcaaattaaatcaaaagacaaaagaatctaaagtcatacagaaggggtgccgtaaggttggagactcttctgaggagcgggcactgcctggcagggactgcacctctgaaggtacaacgaagctggttttggggctcttgcaaaatgggctggagactggaatcacgttccagggtgaagggtggttactgaggcaagaaaggggagaccgcctgcaaatgagaacaagtcctttctccctccttctgccgttcagtctctctagcgccccctcttggcagatcctaaagaaagctgattgcaatgcggaaactggagctgcaaggccccaaaagcaggaagaaagggtttggggctggggggcaatagcttagtaactaacatgattggtaaaattgaaggccaagagtttacttgtgacagggagaatttacaaggaggctctaggaaccaaatgacactgtaacacaaggtttttcagtaccattgaaggctgacacaggcaaaatgactttcaaatgagataatgcaagtgaaatggcctcagatttataaagtaccatgcaagtaggaaaataatagttttaatgttgatgctttaacttcacttttaactatgatggggatatttgataaaagaaaatttgtgaagccaaagataatcatgagataaattatgaaaagatgtttattagttttagaaacagaaataatagtttgccttactttctctaattgaggcaattttattttaatttggaggttttcaaaaggacacacacttttattagtttttctgtcataacttgcagagttttgtggatctttgcaaaaacttgagttaaattttctttaatgatgtgtctatatattatacattggctacataaaagcactgaattactgtgctatatcattacattactgattatattaatgtgtgtctctgtagtgtaataatttttgcatttattcattcattaaagataatcataactaatacaattacaatttcattttaaagtcattattcatagtcatcaatttagagataagaatgaaattatgttgataagttcataaactgatggctggaggccaatcagattgcttcgtgttcccaaattattttataattatgttacttatggttaacatgtggatgtgaaacaaagattctggaattcaagtcatgctaaaagagctgtgagtcactgttcatttttaaatctctcacatagttaaagaaaaggtgtgtagaaactatttcataagtttaattaacatgattatagatattgcatacacttgtaaatagagaaaagcaatctgcaaaaagaacaaaataattctgatactttataaaaatagcataactaaatttagcaaaaagtaagggatcattgataagctagaatattagaataggattttcagaaacggtcatttgtttggggaacgaaaataattgtaaccaggccagatgacatatttataggtttccaggggaaacagaaacttacctcaaataaaaagttgcaagtggtcaatgtaattaaaaaagaaaagtagtgaaattatccaagaacaaggtggggcttggtgtaggaaaatagcctttaattcacacataagagtaacatacaaagggaatacaccatttttaattgaaaactgaaatcaactgaaagcattttagttgaaaacacatcaagtatctgtatcattattattccatctgcagaatgtagttgtaactcacaatgttttcaactatttttttcagtaaatatttactatctatctgtctgtctgtctgtctgtctgtctgtctgtctgtctatctatctatctatctatagagacaaggtcttgccatgttgcccaggttggtctcgaactcctgggctcaagagatcctcctgtcttggcctcccaaagcgctgggattacaggtgtgaatcactgtgctgggccttgagtatgtatttaatgtgtaagactctgtggtaggcaccaacagcagaggcaaaggttagcaaggaattgtcaaggagtttataatctgacaatgtggataaaagaaatatacacacattttgaaagtaaaatataaagtgtcaagtgctataaaaacaatacaaacacaacattttggaagatcgttggaaaaaaagagcatattcaatcggaaagatcaggaaaagcttcatgaaggagagaacatgggagaataagcattttcacaggatgggtaatagagataaataaaaatagtacaagtgacatttgttttgtgctaggcaccgtcttaagaatttatgcatatgatgtcatttaatcctcaaaacaaccacagaacatagtactcatattatcactattccacaaatgaggcttagagaggttaattttccccagttctcacagttagtggcaaatccataatttagaaccatatctgcctaactccagagcctaaaccttgcttactgtattatactcctttgtaaagaagaatcgtttacgaaagcgaaaactgaaaatcctacatctatagtttatttatttgcttattcattattatttttattatttttaactcttttagagatagagtctcactatgttgcccacgctcacttcaaatttctgagctcaagcagtcctgctgcctcagtctcctgagtagctgggactacatgggtgcaccaacatacatctctatattataacagttatatttaacgtgacacttatattttggtaaaatggtgatttaaaagttaatattggtaggaatatgataaaaatgtatattctctcattcagttgtaaagcaaatacaaaattgcacatgcgtttgttatagcagaatcagcatatagtagattctcagtaaatgttgaataaatgaataaataaggtagaaaatctgtatgcatatggacagagattgggagactgatatgtgaaaatgattagttgcaataggattgtgggactttgaggcctagctagtcctctttcagttatctttaattttgtatatggtcggatcatccggctttgagtagaaaccagttgtttatttccttttcattaacaaaggactaatgagttcaacctaaaaggacagatgaatcagcctgtgatatcaataatcaatagagaattcttctgcagaatattcactaacatgcacagtttttgaatagttaaaaaaattttattttttcagtaatgaagaatatgaatcagagaaaatgatgcatatatatcataacttcggcatgcacgaatgagaccagatgaggcaacaatagtttacattttgacttatttctttaatttcaaaaaattgaagtcttattaatcatttgctagttctatgcaatggtacattcttcaaatcatacctaatgataataacaggagaaatgataaatgaaaatggtcaaagcattcaataacatgttgctgttatagtaagattttgaaatagaatgtagcatgttatgggattttgcctttaactagactaaaatatactttattgattcaggtagaaggaactattaaatattatatacaaattactttatacttatttcattaggaaacaacattaatatacatatatgtgcacatacacatatgtttaccagtgaagttgattaacttttagttctggagcaccgtttttcttttcactaaaaaagtggtttctggtggcaacattaaccacatttgtatgtgttgggtcgacctgtttattgattcaccaagaagctgtcaagattttttttttaagcagcatctcgctctgttccccaggctggagtgcagtggctccaatcatgacttattgcagcctcaacctctcaggctcaagtgatcctctcacttcagcctccagaatagctgagactataggcacgcacctcaaggcacgcacctccatgcctggctaattttttaagaaaaattttgcagagatggggtctcactatgttgcctaggctgaactcgaacttcagggctcaagcagtcctctcacctcagcctcccaaagtgctgagattagaggagtaagccaccgtgccctgaagctgtcagttttaaatgggacctagagcaagagaaggctctgcagcaggtctaggctgaagcacaaggtactgtgctacttgggctttatgattaggcagatccaatggcacccaaaatgtctctggcaaatagaatgttgtatgcagcccctgacaaactctaacagaagaccactagcattttggaaacaaatcaattttctctttgagaaacagctcctgtccctgacttgctgctagtccttgttgacattgaatacctggctaagatgctgcaagtgaacatttgacctgaactgtccatctgatccaaaatatcatagggttgggtttgttcagaagcaccccattatcaagtggtggtggtatacaagatatagggctcaagaagttactgaaggcacaataggttgtctgagcaggtggctctaattatcttggtgtctacttctgctgctctaatctcataccccctacccatacctggtctcatgggaagttttctttcattggttgactaagaatacagaaattcaagtgaagtttgtaggtggttttgtacagcatgttggcactagctagaggtggactgaggaaacattacagtgcctctcagaggtggcccagaaggacactgagaaataggaaaaaccctcccagtaggaaaagtagcaagcagtgcatttgagtatttactttgcttggaaggagagagggccagaggtaaggatctacaggaattaataaatagcaccttacaggttggctgggtgttcaggataaatgctggaagattgatgggatgtagatctgggaaaagatttatgaattggcttctagaatagtggcgtatgtgaagatactctcttatggaagataatttaaataacttggtggacaggatgatccaatgagcctttttcccaacaactctagagcggactcttgggctcatgaaaaaaacagtagcaatagaagtcccatgatttcaataccatgggcttcccctcaccaagtgtgaactgatttctgccaatctgaggtcttcaatctggttatcctgttgaagccatcctaaaatagatacagctattgatggaattctagaaaggcaatgaggcctacactaagccctcagtgtggccccattccccagggggacagatagctacccatgggaagttggactgtggactccttccatcctgaaaagcgtggtgatttattatcactagaatagagtcttcctctgtatgtgggtttgcctttcttgctcatatttcttttgtaagcattaccatctttagactttctatctcaatcaccatcatgtgtcccgtacaacattctttatgattaaggaactcattttatgacaaatggtatgtagtaatgtgcttaggtctgtactactcactgatattcccctgcactctctcacccttgacctattgaatgccccctaaaataagcaaagtggggatttccagggactgttacattattagacttgcagacttgttatccaaaggagtaatagtataggtataaactcgttaatttgacctttattatttagtggtatgactggttagtaagtttttatttccatttccatttgcattattatttttgtcttatagttatgctcttaaaatgagacataaaaatccaatattaactgaatcagcatttactattaaagattgttttaatatggtgttcaacatgagaatgttttataaactagcatcaagtggctttcactgacatttatgaatgagcttagtactttaatcaaataaggatattaagagctggacttgaatcccatttagattctaattttgttttgtataatttttcaggccaaataacttcatgtatttttaaggattctaaatcaacaccagatattaaagtcggaaactatttcaaatgccttgtcaaaagtctttaagattatttagggaagtatttagtgatgtaattttaggactttggtaaatattgtattgctttgattatattttaaaaaggctgttactgtcaaaacataagtagctaaaaatttaagctaaaaaatactttgagtaggagagagaacatacattataataactggaaattgtttttatgagctatcttctgtaaaaaaacattggaggaaaatgtcaacaagataaagacatactactaatataaacagttaaatgttctgatctaaatatggcacactcaagatgaaattaggccaaaaattaaacacaatataccaagcagcctaaaaattgtgtaacctagaggttaacataagctattctgaaatgaacatatgaagtttacagaatgtataaagctgaaggtgagttttacaggcatttgaaaaatttactttgcttctctcaaaggaaaaaaaaaacgtagttcagtataatcttttccataataggaaataaagacttaagggcaaaagtgtagtggttctgatgcagaaaacttacaactgctgtcttttcatcatctatgctaacaacatatagcccagcaaaatgcagcctgagctttgtcattgaccaaatcaggacaatgtttcttacatgaaaagtgttgcaatgaatgcaaaataatctcaggcattctcagaactgggagacaggagaatttaattcaagtcctagttctgcctttgagtaagcagttcaccttcctgagccttagtttccatgtatgtgaaatgggcatgacaacttgtactctctgacactctgagttactgtgagagtcaaatgaaaacccaggcccacatttgtgaaatgaatatatgtatgaagatatataaagacatattgtaagttctaaagctgtaaatgaaaataaattattaattcttttatcccaagtttacagtctgatggaggaaaaaagttgttttaatttcaagaagtatggctagttaaaatattttgctatgtttggttgcaggtggttttatatataaatgaatgcaacagcagttgcatttaatatataaaagaatgcaacagcagtgtgttagtctggctgtcacctaccagatgtcattggatgagcctatcacactttctttttccttcatcctgcaaccaggatggtattcatagagcttggggtggtggccattaccaatgatgtgttaatgatcaactctcaccaaccacttttgtcatcctggtatgtactgcctctgggtcagccgtgggagtaacaaactcaaaagctataggagtgaagaccccaaggtacctgagaagtaaacatggtgaattttgtggcagactggagacacgtgaagagaaagcccttcatcttcaaccagttgtcagaaggaaatgcaagtgtgcgtttccaacatcgaacatcacaagatattggaaacctggattttaataggaaatctcttgaatttgaaatgttggcaacacattccaaagttttattttaaaaatcctatacaggtcaaacaaaacatgactgtgcggttaatttgacctgctagccctctttgtccactctgcttgatgtatagctgatatacatttaaattgtagtgtagtcctctacatgaagggctacaaaaagaagcaaatggttctacaggggaggtggggacccagagacaaaatttcccaattggtaattttttttttttttttttttttgagacagagtcttgttctgtcgcccaggctggagtgcagtggcgcaatctcggctcactgcaagctccgcttcctgggttcacaccattctcctgcctcagcctcctgagtagctgggattacaggcacccgccaccacacccggctaatttttttgtattttttagtagagatggggtttcaccgtgttagccaggatggtctcgatctcctgacctggtgatcctcccacctcggcctcccaaagtgctgggcccaattggtaattttgcctcagggtggcccctgtacaagcagggtaaaagaagaaaagatcaggaaggtgatttgaaatggtgacagttacctccattaacagagttgggatttagagaccaaaactatagttgagcatcatgccgtaacaggtgttgagtcgcatcaagcagggtgctctccaggctgtagtggtgattgtcagggaattaatttctacagtcatgccttgcagaaaaaaggtttctctgaaaattctgttaacaaacacgtaaggatattttttcacacattcatcttgtgccatgcattataaatatttttaaggaagaatgccataaaatcattagaaaatctctaaaggggggaaaaacgtgtggaatccaaagaaacaacataaaatgtttttgtatggcttcagatgatttaagaacttacctttggtttattgtaggaaatttatattactttatactaatatgattagaaactgtttagaatttggtgggtgcatgtctaatggaattaaaaatcactccattacagaatataactaaatttcactacgattcgacttaaatacatttagtggaggactagtttactaatccatctcagagagagaaatgagtgtcattcttcaatgtaaggatgtcctgtagaaatccacgggtctttggggggaaaaaacaaaaagaaggaaaaaaaatatctcccacaccaagcactggtgcatgtaagcatgactggaaaatctgtctgaatggaggagcaactgggattgaccctggaaaaacctctgagaacttgtctgtattgtgcggtacgccagctctgacttggttttggccagctctgtgcaaatcgtcactctttggttctccccttggcccaattttcatgtgcgcttggcacattaacagtgttaataatattgcaagataaaattagctgggctttagaacataaataatgtggaattcaattacttgtatttataaattaatattatgccttttatatgcagatacttgagaaaaacccttattttatgatatatatttgaaagtaataaaactgaatttattttaagaacagtctttgggtgtcgtaagatccagacctcactcagcctaaagtactagagtgatcaagtgggatctatggatcccaactactaggatggctcttccgctgactaaatatgtggccttggacaagtcacttcaacattctggattttatttcccttcttggtaaaattaggagataggagtacctgtcctttctattgtgaagctgtctcagagagggattttgaggaaagagggaaaggatcacacatggttttggagagcgtggaggtagactctgcatgagctccagagtctggcaacctgaggagcttaagataattcaagagcaagcgtggtgggtgcgagatgatttgggggtcaccagggtgtaagttgtaaagagcatggcagttaacggctaacaggaacactgaagtgatggattgaaggggagggccaagagcagaactctgggaggatatgagcatctatatttagctcctatgtccagtgggcagcacgaaagttacttttagttatctcttgcttaattattatgctgaagtacatcagcctcttccctgagaaagaaggattttaggagtacagtaaaattagatggaggccaggaagagttaaagtgtacccttgctgtctttctctccttccctccctccaatccagagaaatcccccaaatctgagaggtggggagaggaagtcagagtttccctggatgggatgcccaacaggagatgactgggggctgggtaacagggagggatttcataaggatttcacttatatcctgaaggtgggggggtttgtagtcaatatcagaaatgattccaattgtgcaaagttggggtgtatatctaatgcttcccccttaatactaaaagggaaggggacgtaaaccaactatcagacaagattcctatcagcctggccatcatatgcttggagtctggagttactaaatcaaacacagcagatctttgggtctagctgagccttccaacccacacagatcccatgggtatgggtatttgggcttagctcctattttactggatttcgactcctcaacaggtttgggacctctcagctccacgcagtggcctctgatgtgccctgtgaggagacctagtcactttggaccctctgtctcttcatttttatctttactaaatagctttagttttcttaaatctttttgttccctgacctaccccttttggatcctatgacttctgcttggcttcaggtttttgtttaggccaatagagtctatttggtgtcactactagaagagacagggtgaggcaggtgaccagccatctcagtgtgcccaggactgaagggttcctgggatgtgagattttcagttttaaaactgggaaagtcccagaaaaaccaggactcactggtcaccctaaaaggagaagaaagaggaaatgcagtattccaaacgccgcatggaatatttacacaaaaaacaacctttttacactaaaaagattaaccttctcttagcatatttcctatgaccttaaagaaactccgtttctttgtttgccttgaaaaacatacatcttaaaaccctgtaataaatccctttctgcttaaactagctagagcagattttcttctctgcaactgaactctacctgactcagtaccatatgttatatttacactgaagagatttctctaatgagctaaaaatcattttgagagaacttgtgtctgggagttctgtggactttttttctgaccaccaattttcctcctttcttttggtagccatatcctttgaagaagcaccccatcccttgtctcagtctgggtaaggctgatgccacactcaggcctggacgacaaaggaccttctctttctgggcacagcgatgattcacaaattggcatgtgacacaacaggggcggatgaggattatcttttgggaattttacttgagctgctgggaaagctgtttatttgtttttgttatgtatcactgttgtagggacaatttaaatgaggacttgccagtgaacaccaagcttgcttgagaatgaaactagccaagaagaaagccgggttgcaagggagagaaagagactgcaggcttagcacctttttggaactagatctggtcatgcctgaagtggctttgtagttacaggagtcaataatactctctattttgcttcaatgaaattgaatgccatttctgtcactagacaaccaaagagtactgaataattcaacataataaaataaaatgcatatttataaacggataaatttgggacattattatcataaaaccaattgcttgtttaaatacttagtttgcacttaatgtgccattccactttaaacattcgattggcatatacgctttcagaaacacccatagtagttaaaataagggaaatttggtagaaccccttctcttagcttggcactattgcttattttgcatgatgcctggaacaagttacttaacctcttctgcctcatctgataaatgtacacgataatagtaattaccatatagatattgggtatagaaggctcatgctgctagaacagtggtttgcacataatgagcattagctcttagtaacgaattgttgttaattcgttaacttttcgatcacatttaaagttattttaacgtaatagtttttggccggtttagataaaaacatgtagcatcacaaatatgtaagtaaatatattgagcccttaagtataacgaatgttagaagcagttatgtaaataagcacatatgagagaaaggctcaaaagttataatatacaaaagacgaaacattatttttatatgctgtccaggttatgattcatttttgctcattaaaaatttattatattgtttttccataaggaaaattaatatgactatattaatatatttgcaaatagttattgtaatcacttatgtgttagtaatttattatataaataaaattattatattatataatatataaataaattactaatacataactgatgataacacagaagtatgtttcagagagttgattttttaaaaaactccatattagactaaatattgtcacttaataagaatacacaatctcacaaacagcaaaatacttcactgcctttgctttttaaaaggaaacaaaagattagaattgggtcatatatccaatgtgaaatgtagagtatttcaattaagattcaagttgactttttaaagtgttgttcaagtcaaatgctaccctgtgtcaattgcttccagctgctgaatgagtttgtaaagttatagggcattataacaacattgactgcaacacttcttaatttcacttttagaacataggagataaatcacattgtgtgtaaaagtgtatcaaaataataagcaataaataaagaataacaacgataaataataagtaatcccctctctggtcttggagaaatatgtgtgaaacaaaggctgaaacatgtatgtaaagttttaaaggtgaatcaccaattgctttcagtgttagtttatcttacatctttccattcttcagtagaaaattttgcatttatttaagtaagtgtttttgctttttttcttaattttactataggtcattttcttgggaaaataacggtgacattgttgcatatgaaaaccaagaaacattgtgaaagatttaattcatgctatggccatttcagcagaatctcactgaattttatgtatatgaaatgatttttaaaaaatagtagaacctttccatggccaagcactacctacattgccccactctgtaaactctttatgtcaaaatgaaaactaaatgatattttgaaacaagtgtgcacatataaaaatttcttctagaatccagtggtctcagaatggattgaagagaaaaaggttcactgctgaccaggggcttatttcccatttttcatttctgtttgtaattcctgtcatctttgtttcttgtgcttttgctaaaaagggcgactcatatttattggacctgggtttcaataaacagtatgcattatggtgaaccaaagagtgatttattgataatttgtcacttatatttatgaaattgtagaccccagagctccagagcaggtaaatcatattccacagcctcaatgtgttggtccccgtccgcccgcacccccactccactccataagccaaccgctggctccatttactgccaaaagctcacatcatgtaagctgacagccccatacttctcaggtcctggtcatcatgcacttacaaatacaagaaaaatagaacaactgttggagacttacttgttttttcaatgtgttttcaatttatttctcaagtccagaaataataaattaataaaacataattagatgtaaaattacaagttaatgaggctagagaaggagcaagaatgtaaaaggaacagtagattgtgagattttttttttagtttgtttattatgatacagctgtatagaactttcacacagtttccagatgcagacagctgttagtccgttgctattaaggaaacaaaggttcagagttcattttgatccacttgttctagactagtggtgtttaacatggcacttcactcagtcatatacaagactgtcaagatgggcatcatgtcttcacttgccttttgctgctcacttatctcttctggcaacctctccaacagcaagctgccccactcttcctaacatgtttatctcccatggtgatgtcagcagaactcagcaaatctaatattcatgctcaaacagatttgttggtgctctttgtttataagaatcagccctgtatcactcttgcagctgcttcctctagataatgcatacagggctttgtgttttgcattctctttagacaggacttgggcgacgaacaaagcacctacctatatctgactacaacctatttttttttttttttttttttttacaaaaatctaattccgatttttttttccacggatgtgactataaccttgtctttttccgcttggccacttcttttggacataaaatatttacagcaatgaaacaatgcatatgttttcttttctggaggaataatcaagagaaataagattttaaaaatataatttaggcagaagatatttcttaaatgtaatgctctagggctaaagaatgaaactcataaaaaatgtatgtatgttccacatggaagtctacaaaaatcatgtcgtatgtactattttataatatcccaagtttttgtagtaattaactattgcttttcaagtttcagttacttttaatgatttagggacaaatatataatgcagatatgggaaacagacatcattagctgtggttgcaggtctcttttacacaattcctggtacaaatctttatctctttaatggaaaaacacatgctgatttaaaaatctgcaactacttgagtcaagatagttggaagcttactaactggtggatgtgggacttgttttgcatgatgactttaaggtagtcgacttccacactttctcatttatatatgagcctgtacatgtaaaaatggtttctaaataagtctcaactgtatttattttaaagcactatggtgttgtagcacctttaggagccattttgattaagaactaaattatacatatctttatacaactttctaattttaaataatgaaacaccacacatttgtgttacatcactggattgttgatctttacaccttttggggaacacagtactaaatgtcaacctataacaaagtgccaattctgcacccaaaagcgttatatagtaggtgctcacttaacgtaattgataagttatttgaaagtgagattttaagtgaaacaacatattaatgaaatcaatcttcccctaggctaattgatataaacaagagttaacatcctatgtcatatttctggtcacaaaatcattaccaagcttctaaataaagaccagaatagttctaatattaaacagtgaaataaatgtgataaatacatttaagaaagattaatcgaaaccattaagataactatttagtgacttaggggtccaggtagccagagcccatcctgactcagggtggcaggcgggaatctaccctggccaagccacccccccattgcagggtgcctcacactcaccctcactcacccacaccgggaccatggagatgggccacttcatctcacatgcaaaactgtgagttgtgggaggaaactggagtacctggagaaaacccacacagacgtgaggagaatgtgccaactccacgcagtgtccttggcaggaagtgatttttttttccttatcaatgctataaggaaacgatgttagccagatgacgttattagaggacctgcagtatcctttccaaggccatcatcaactaggcttcatttgctggatctgcagtcaaagtacggtctcagattgtctcctcatttttaaagattttaaaagaccagtcccttttagtttgtatctaggattagttaaaaacctagtctagatattataagcattggttttctttttatttatttatttttttttttggtgtgctgcacccagtaatttgtcatttaacattaggtatatctccaaatgctatccctcctccctccccccaacccacaacaggccctggtgtgtgatgttccccttcctgtgtccatgtgttctcattgttcaattcccacctatgagtgagaacatgtggtgtttgtttttttgtccttgccatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctatcgtgaatagtgccgcaataaacatacgtgtgcatgtgtctttatagcagcatgatttatagtcctttgggtatataccaagtaatgggatggctgggtcaaatggtatttctacttctagatccctgaggaatcgccacactgacttccacaatggttgaactagtttacagtaccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagtgttttttcacgtgtcttttggctgcaaaaatgtcttcttttgagaagtgtcggttcatatcctttgcccactttttgatggggttgtttttttcttgtaaatttgttggagttcattgtagataagcatttattttctagtagttagtgagagcttaactgtatgttgaacttacatgcaaagatcttagagtgtaagctttcacgtaatttgacactggccctataaaattctcagtgtcttcattttataaatttataaattgaaatttggagatttaatgcaaactgacccaggtcacattgcaagccacagatggggtagttttataccaattttttaataaaaattttaaatataaatttatatgatacaaataaaaatgttaaattttaaagacatgttttaaaagactatttgttgtgttttgagtttctggaagcagtgtaaggaagtaagagcagaaatcaatacttagttggaccaggatgatgtgaggaagggccagttggagaatttgtggacaccctcatacccagcgtcaactgtgtgatgccaatatcagtgcgaacatcttatatttaggtcactactacagtgatagaattatgtgcaaaccacagccgatgtgagcatcatctttggtttgtcatcaggcaacacattggtgtattaatggatgtgtgcttttctgataattttgtctccctgtgtttctttgtaaactatgtgatgaatcagacctaattttatcccctttgagaccaaaaaagtgtccataaaagagaaaaaagagagaatggaatgtatacaagaaagctgaggttattaagttccctaccaggactcacttgtgtggggtcatggaataaaatctggtatgagtttaagggctctgagggcagagaggaactgtgctttgcctagctgtttgtagcaagatgaatcttctggccaatatggcacaggggcagcagagcaggcatcactgcatcaaggtgtctagacagaggagctggagtcagatgcaggtttttatgtgccccagtgagatgggcacatacccgagagaagcacttgagacagatcttgactgatacttggagaatggtctgtgatctgtatgaatcaggaaccagaaaccagatgaaagtgacgtgtaatagcagggcagatgaggtacaagcacgtgacactctgtgtcccctcccgtacaaacaacatactctctggccctggggcttagatattattacaggaattgggtgatagggagagaccctaagatagttatattttagagttttgtataactgtatatttttcttcacctagtgggatgggaaatcaaaacagagatgtttcgtggaacaacaataaagaaagttatgcttactgaaatgctaggtttaggatctatatatgtgtaactgttcaatttcattaatagaaatgaattggtattgtcattgtcatatcagccatgcatctttgaaactgggactcatagagattgtaacctgttctatgtcatttaataagatagtggctcgctagactctagtcttttacttggtctttgtttagtttgtgttagaataatatttacctctaataccagaaaacaaaacaaaaggctcagctttgcttttgctttttttttcttttctctctctctctccctccctcctttcctccctccttcttccttccttccttccttctttctttctctttctttctctctttctttctttctctctctctttctttctttcttttctttctttctctctctctcttcctttctttcttttctctctttctttctctcttctttctttcttcttctttctcccctccctcccaccctcccttccttccttccttccttccttccttccttccttccttccttccttccttccttccttccttccttgtctttctttgttgtgaaagatcagggaagggagatatcagtgcaggctgggtgcttattgaaacaaggcatgcataaaactggtcagaacctaataaatgagttgactcagaaaaataaggaagagaagaaggaatagtatgtattctgggatgagtggacagagaagtgctacatggtgggactttggaagggtcggcataatggaagggaggctttatgtccaggaataggttgaagagggagttggaagactgtaagggagaatcaggcaatatgagccactgcagggcttaaaagggaaagtgatgggatcaggcagtcgtttaggaactttagtctaatggcagaaacagagatgaattagagatggtgtgagtgtagagaacagaacacaatcttgttgaagtggagtgagcaggaggactaggaaatggcacctaatttattttctttcataaaacgaatcgcagtctgacattctatttacttgtttattttgtttctttccaactagaaagtaagttgcatgagtcaaagaccttatttgtactaattcacttctgccttcccatgaccctgtacatggtagatgcttaagacatgtttgttgaatgagtataaataaatgcaaatatctataaataatacattagagagaaattttaaagaaggaattgatttttaaaattattgcaaaaacacaaaattttaatctaatctgataaacttaataaggtgcaaacatttaaaaaatcaggtagcccagttcctgcttggatgagtcatataaaatactcaaactttcagaaatctgtcccttcctttcctgggataagtgtgtgtggagttccttcttcctcttcctgtctgattttacccttctttatgtgcaatgctatcatcaaaactaccaggactgcctcttgatatattaaacaggaagatgaaagaatatagaaaattcatttttcttaacaaggcctgcctttgaaaaggcttagcttcattttaatgcaattttgcataatgttatccttgattcatgcaagtatacctaattttactgcactacactatttcactttacagacactccattggtgttggattacatggatagattctttagtggtgagttctgagattttggtgcacccatcacctgaatagtatacactgtacccagtgtgtaatcttttatcccttactcccttccaaccccatgccccttagtccccaaagttcactgtatcattcttatgcctttgcttccttctagcttagctcccacttataagtgagaacatagcaatatctggttttccattcctgagttacttcagttagaataatggcctccaactccatccaggttgctgtgaatgccattattttgctcctttctatagctgagtagtattccatggtatatacatataccacatatcctttatccacttgttgatcgatgggcacttgggctggttccatatttttgcaattgcaaatcgtgctgctataaacgcgcgtgtgcaagtgtcgttttcattaatgacttcttttcctctgggtagatactcaccagtgggactgctggatcaaacggtagatctacttttagttctttaaggaattacacactgtttccatagtggttgtactagtttacattcctaccagcagtgtaaaagtgtttccttcataccacatctatgccaacatctattattttttgactttttaattgtggccattcttgcaggagtaaggtggtatcacgttgtggttttgatttgcatttcactgataattagtgatgttgagcattttttcatgtttcctggccatttgtataacttcttttgagaattatctattcatgtccttagcccactttttgatggaattattattttttttcttgctgatttgtttgagttccttgtagtttctggatattagttctttgtcagatgcatagtttgtgaaagttttctcccactctgtgggttctctatttattttgctgattatttgtttggctgtgcaggagctttttagttaagtcccatctatttatctttgtttttgttgcatttgcttttgggttcttgatcatgaagtctttgcctaagcaatgactagaagtgttttcttaaacattatcttctggaatttttatggtttcaggttttatttaagtctttgatccatcttgagttaattttttttttttttttgagatggagtctcgctctgtcactcagactggagtgcagtggtgcaatctcgactcacggcaagctccgcctcctgggttcacgccattctcctgcctcagcctcccgggtagttgggactacaggcgcctgccaccatgcctggctaatttctttttgtatttttagtagagacggggtttcaccgtgttagccaggatggtctctatctcctgaccttgtgatccacccgccttggcctcccaaagtgctgggattacaggcatgagccaccgcgcctggccgagttaatttttgtataaggtgggagatcaggatccagttttatttttctacatgtggcttgccaattatcccagcaccacttgttgaatagggtgtcctttccccacttgatgtttttgtttgctttgtcaaagatcagctggctgtatttggctttatttctgggttacctattctgttcgttggtctatgtcctatttttataccagtaccgtgctgttttggtgactataaccttacagtatagtttgaagtctggtgatgtgatgcctccagatttattctttttgcttaatcttgctttggctatgcaaactcttttttggttccatatgaattttaggattgttttttctagttctttgaagaatgatgatggtattttgatgggaattgcactgaatttgtaaattgcttttggcagtatggtcattttcacaatattgattctacttatccatgagtgtgggatgtgtttttatttgtttgtgtcatctatgatttctttcagtagtgttttgtagtttttcttgtagaggtctttcacctccttgattaggtatagacctatgtgttttattttatgtttttgctattgtaaaaggggttgagttcttgacttgattctcagcttggtcattgttggtatacagcagtgctactgatttgtgtacattgattttatatcctgaaactttactgaattcatttatcagatctaggagctttttgtatgactctttagggttttctaggtacaaggtcctttcattggcaaacagtgacagtttgacttcctctttacctatttggatgccttttattatttctttctcttgtctgattgctctggctaggacttccagtattacattgaacaaaagtggtaaaagtgggcatccttgtcttgttccagttctcggcgggaatgctttcaacttttccccattcagtataatattggctgtgggtttgtcatagatggcttttattaccttaaggttgtccattctatgctgattttgctgagggttttaatcacaaagggatgctggattttgtcagatgatttttctccgtctattgagatatcatgtgatttttctttttaattctgtttatgtggtgtatcacatttattgacctgcatatgttaaatcatccctgcatccctggtatgcaccccttttgatcatggtggattatctttttggtatgctgttggatttgtttaactggtattttgttgaggatttttgcatttatgttcatcagggatactggtctgtagttttctttttttttttttttgttatgccctttcctggtttgggtattagggtgataatggatttatagaatgatttagggaggattcattctttctctattttttggaatggtttcaataggattggtaccacttctttgaatgtcttatagaattcagctgtaaatatgtctggtcctggacttctttttttcttggcaatttttaaaattaccatttcaatctcactgctttttactggtctgttcagagtttctatttgttcctggtttactctagaagggttgtatattacctcctgtataatctaagagggtttttgtcatcaggagtatattaatctcctctaggttttctagtttgtggataaaggtgtttatagtatccttgaatgatcttttgtatttctgtggtgttggttgtaacatctccaatttcatttccaattgagcttatctggatcttctgttttgttttcttggtaaatctcgctgatagtctatcaattttgtttatcttttccaagaaccagttttttgtttcatttaccttttgtatttttttttttgtttcactttcatttagttctgctctgatctttgttacttagtttctcctgctgggtttgggtttggtttgttcttgtttctctaatttcttgaggtatgaccttagactgtctatttctgctttttagactttttgatgtagacatctaatgctgtgaactttcttcttaacaccacttttgttgtatcccagaggctttgataggttgtgtcactattattgttcagttcaaataattttctaatttccagattaatttcattgttaacccagtgatcattcatgagcagattatttaatttccatgtatttttatggtgttcagggctccttttggagttaatttttaattttattccactgtggtctgagagggtatttgattttgatataatttcaattttcttaaatttattgagacttgttttgtgtcatatcatgtggtctatcttggagaatgtcccatgtgctgatgaacagaatgtatattctacatttgttgggtagaatgttctgtaaatatctgttaggtccccttttctagagtatagtttaagttcattgtttctttgttgactttctgtcttgatgacctgtctattgccatcagtggagtattgaagtcccccactattattgtgttgctgtctatctcatttcttaggtctattagtaattgtttttttataaatttgggatctccaatgttaggttcatatatatttaggactgtgattttttcctgttggactagtcttttttatcattatataatgtccctctttgtcttttttaactgttgttgctttaaagtctgttttgtctgatataagaatagctactcctgctcatttttgatgtccttttgcatggaatatctttttccacctctttaccttaagtttctgtgagtccttatgtgttaggcaagtctcttgaagagagtagatacttggttggtgaattcttatccattctgctattctgtatcttttaagtggagcatttaggccatttaaatttaatgttagtattgagaagtgaggtactactctgtgcatcatgctagttgtttcctgaatactttttttgtgtgttattgttttatagaccttgtgagatgtacgctttaagggggttctattttggtgcatttcaaggttttgtttcaagtttaggattctgcttagcagttcttgtagtgctggcttggtagtgatgaattctctcagcaattttttgtctgaaaaaggctttatctttccttcacttaggaagcttagtttagctggatacaaaattcctggttgataattgttttgtttaaggaggctaaagctaggaccttaatcccttctagtttggacggtttctactgagaaaactgcttttaatctgataggttttcatttacaggttacctgatgcttttgcttcacagctcttaatattctttgcttcatcttgattagatagcctgatgactgtgtgcctgggtgatgatctttttgcaatgaatttcctggctgttctttgagcttcttgtatttgggtgtctagatctctagcaaggccagggaacttttcctcaataattccctcaaataagttttccaaactttttgatttctcttcttcttgggaacatcaattattcttatgtttgttcgtttaacataatcccaaacttcttggaggctttgttcatttctttaattatgttttctttgtctttgtcagatgggattaatttgaagccttgtccttgagctctgaagttctttcttctacttctttgattctgtttttggactttccagtgtattttccagggtattttgcaaataaaagacacatctaagtgtgtctttcatttcaggaagttgtgattattttttacttatgctctccatttatctggagatttttttcatccatattctgtatttttttttcaatttctttaagttggttttcacctttctctgggcccttcttgagtagcttaataatcaaccttctgagttcttttcctggcaattcagaaatgtcttcttggttttaatccactactggtgaggtagtgtgatctgttggagaagtcaaagtaccctgttttgtcatattaccagaattgttttccttctcatcagggtagactatgtcagaggcaagatctgggactcaagggttgttgttcagattcttttgtcccacagggtgctcccttgatgtggtgctgtcccccttcccctagggatggagcttactgagagctgaactgcagcgattgttattccccttctccgtgcagccacccagtggagctactgggctccaggccggtactggggaatgtctgcaaagagtcctgtgatgtgattcatctttagctctctcagctgtggataccagcacctgatctagtgaaggcagcaggggaatgaggtggactctgtgagagtccttggttatagttttctttagtttgccggttttggttttctcaaatgctggttgtgctagaagtgaagttgtcatgtggacagactcaggacctctggttagccaggatgttacaggtggtggaattagctgttgttttctcctttcttggagtaaggttgttcttttatgagttgctctgatggtttgagttggttggtctccagccaggatgtggtgctttcaagagagcattggctgtggtggtataggggagatacgagcttgccctagggttgcctgtataagtacttgggtttctcaggaggtgggtggggccgtagagttcccaggggattatgtcctttgtctttgactaccagggcagataaagaaaaaccatcaggtgggggcagggttaggtgggtctgagcacagaatgcccttgagtgggacttgctatggccactgtggtggatgggggtgtggttgtctggttaatggagttatgttcccagggagattatggttgcctctcctgtgtcaggcagtcatcaggcaagtgggagaaaaatagcagtgacaggcctcactcagctcccacatagccagcaaggacaatctcactcctgctgtgctccaccaacagccaacggagacaagtttatatccaggcctctgctgtgcagggctgagatcctgtccgttgctataagcctccccattaagaaagcaagcagggctctcaagcctcaccctcccctgcctgccgtggtgtctgtgctcatatctgcacttccattgcacctcctgacccccatcccaaattctgcccaggaaaatttgcactctgtcaaaattattactaagttcagctggacgtttctttctctctgtgacctctccctaattccactagcaaccctcctcaagtacccctgtgagataaactcagaaatggcttccctgggccgctttggggactgagagtgcctacagggctcttcccactgcttcttctacttttatatttcactcagctctctaaattcatttcagctctaggtaaggttaaatccttcttctgtgatctggattttcagactcctaggtgaggatgtgtgtttgggggcagacttcctcctcttacactttgggtactcacagtgttttggctgtctcacagagtttgcagtggcaaactccttctttcaaagtgtctgcaaattctctcaattttcctggtatgttcctgaggtagttcttggagcaaatgttcacagtgtggttctccacatgccgttctgtccatctaagtgggagttgcaagttagtcctgcctcctgtctgctattttcccctctaatccagaaactgatttttttttaaacaaattgaagatctatgacagctctgcatcaagcaagccttttggtatcatttttccaacagtatctctgtgtcacattttggtaacttttgcaatatttagaactttttcattgttattatatctgctatggtgatctgtggtcagtgatccttgatgttactattataattgttttggggctccacaaaccatacccatagtagaccacaaacttaataaatgttgtatgtgatctgactgctctactgactagctgtccccccatgtctctccctcttctcaggcctccctattccctgatacacagcaatattaaaattaggctaattaataactctataaggcctgtgagtgttcaagtggaaggaaacattgcacatctctcactttaaatcaaaagccagaaatgattaagctaagtgaggaaggcatgtcaaaagccaagaatggctaaaaattaggcctcttgcaccaaataaccaagctgcaaatgcaaagggaaacttcttgaaggaaattagaagtgctagtccagtgaacacatgaatgataagaacgtggaacaacaaccttattgctgatacagagaaagtttgagtacaaagcctaattcagagcaaagccttaactctcttcagttctatgaagactgcaagatgtgaggaagctgcagaagaaagatttgaagctattagggttagttaattaggtttaaggaaagacaccatctccataacataaaagtgcaatgcgaagcagcaagtgctgatggcgaatttgtagcaagttatccagatgtagttaagattgttcatgaaggtggctacaccagaaaaatggattttgatagaagcaaacttctgtttagagaagatgccatttaggactttcacagctaaagagcagtcaatgccttatgccaaagcttcaaaggacaggcgaattctctcgtgaggggctaatgcagatggtgaatttaagtcaaagccaatgttcatttattattgcaaaaatcctaggatccttaagaattatgctaaatttaccctgcctgtgctctagaaatggaacaacaagcctggatgatggaacatctgtttacagcttgactcactaaatattttaagcccactgttgagaactactgcttagaaaaaagtattcctttccaagtattactgcttattaacaatgcacctggtcacccgggagctctgacggaaatgtataaggagattaatgttgtttttatgccttctaacacaacatccgtcctgtagcccatggatcaaggagtaattgtgattttgaagtcttattatttaagaaatacagtttatatttgctgtagatagtgattcctctgatggaactgggcaaaataatttgcaaaccttctggaaaggattcaccattctagatgtcattaaaaatattcctgattcataggaggaggtcaaaatatcaatattaacaggagtttggaagttgatgccaactgtcatgatgactttgaggggttcaagacttcagttgaggaattaactatagaagtggtggaaatagcaagagatctagaattagaagtggagcctgaagatgtgactgaattgctgcaatctcctgataaaacttgaatggatgagtagttgcttctcatgtataaggaaaagaaatatggatgaagctggaaaccatcattctcagcaaactatcacaaggacaaaaaaccaaacacctcatgttctcactcataggtgggaattgaacaatgagaacacatggacacaggaaggggaacatcacacatcagggactgttgtggggtggggggaggggggagggatagcattaggagatatacctaatgctaaatgacgagttaatgggtgcagcataccaacatggcacatgtatacatatgtaacaaacctgcacgttgtgcgcatgtaccctaaaacttaaagtataacattaataaaataaaaaaactaaaaaaaaagaaatagtttcttacaatgaaatctactcctagtaaagatgttgtgaacattgttgaaatgacaacaaaggatttagaatatttcataaatttagttgataaagcagtgacatggtttcagaagattgatttcaattgtgaaagaaattcaaagggtaaaatgctgtcaagcagcattccttgctacagagaaatctttcgtgaaagaagcatcaactgatgtaacaaacttcattgtcttgtcttaagaaattgccacaaccaacccaaccttcagcaaccattaccctgagcagtcagcagccatcaacatggagaaagaccttcaaccagcggaaaaattatgacttgctcaaatgattgttagcattttttagcaataaaagattttttaaatgttatgtacattttttagacgtaatgctttagcaaacttaatggactacagtatggtgtaaacctaacttttacattcactgggaaacccaaaaattcatgggactaattttattgcaatatgtgctttatttcagcagtctggaaccaaatgaacccacaaaatctgtattctgatgccacttggcctagggaatgcaactgctcaagagtaatggatgaacaactggaattgcaaaggcttcaacagtagtgttttgataaatgcctcagaccttaatgcttataaaaattggtgaacccacagtagtctctggaagtgtcttgaagaaaaatggtcgaaatatgtttagtcagaaagccaatctgtgaaaatataatagtttctgaagtcttaagcaattcatgactggctaggagcagacgttccaacatacctctttcagagcctgggatgttaaaataccatttagatccttgaagtaagctgatattttcacctcataaaagtacttctgcatgttcacctgagaagaagaaaaaagtgacattttctagtggctttcatgaagtatcccagtactctcaaaaggaagaaacagaaaactcttcattgccagatgcttggagatgggagggaggtagtacatcagtatctgtaattcttatagcagtattgtttcaaaacatgctatgtacatacttacatacctatgaacagacatgtcaacattctttagcaatcaatctaaagtcttttcctcctagactcctgttctctctgcagtatattagaatgcaaagatttcagcaggagttggattcattcttggataccacttaactattctgaatttcctgtatgtcagctttctctgagtttttaatcctatgagagatgccagcttttaggaacatggataggacatccccattttgtcactgctggggcacaaaatccctgccatgtaatttaatggtctctttcctctattgaaattaatatttgaaaattgaaagcccaacattagcaccaaatattttaaacattttatagcccttcagctgttctgtagtgccagtttgctttccattccccttgacatctcacaatgctaagtacccagggacagcctgtagaggtttccccataatccacctttatccattaacagacactcaatcactaaagtgcttactagactaaacatatttatccaaccaaatcacactttacaatgcaaatctgccaatcagaccttggatattaacgaggaactgctttaaggggattttggtgtttgtgctgtgaagagcctgcttacctccaacgaaccactaaaccaaattaacatagctgtatcctcataaaagaaaccagatatcctgttgtgaaaatagagagcttggtgggacaggcctcctttgatggctaacagtgtggcagacaagggttcagacttcaaatctggctaccacaaagtcattatgaacctccagcatcaggcttttgataactttaaaagcaaaataaaaatgtagcattggggtaactcagtaagttgtcaacttacccagttactattataattgcaataagtgctgtaattgttggataaggctccttaattctaattgctccttcaaccaagatcatgttgtaaaagtgcttgcattagccaaaaataaaatccaagagacacaaatgtggtagtaataataattctttttattggcctgaaagagaggaagagaacaaagctttaaaaacttcaaagttctgaccagaaaaaaaaaatcagaattggagaaactcatacactctttgcccctttattagaccaatgctcactaagtgccatcaccatgagttgaggggttgacagcacttttttttcaggtctgcgagtaagttacaccatctatgttgccgtcttaatttaagatttctgtcacaaactacataacacagccctgtatgtcctcactcagacctcttaatcacttcagacttattggtattatacctcctttaaataccaatattttaaggccgctttgacacttggtagggtttgaggtaatttttttctccccacttagctagcaagagaagaaaggcagaatttactcagagttaaagtacagacacagtgtaaatagtaattcgtaaaataataggcaattatgctgcacagaaaaagaacgctactgtatctcaactctacacttcgggtcctaaaatgaaatatgaatttccagtctttactgtttatcaaaaataatgagcactttcttattttggtagactttataggcacttctggggaaaatattatgtgtggctagaacaagcttcattttggaggccacttttcactctggaataatttccaaagtgaataaaccacaacatgtgcatttttccaaagatcagccgagtagaaacttcaagccaaagtagaaattaaattgtcatgcagcaaaatgtcagtagtttgctagaaatagtttaggagcatgcgtacatgcctgaagtagaaataataaatataagtttttgctcgtatatatatttaatttttgtctaatactctcatctctcataatacaggaatgagttaagaaagagttgctagatgaagcatgacatatatttgggctagatttttgctgtaaaatgtgtgtaaaaccatctggatggcttacttatttagaaaatgaaacaagtagcaatggttttgtatatgtgtgaagatgtataattttttcaacatttgaattaataatgtgaacattctatagataagccagcatcccatttatgttaactgcaccaactcatgttcttataaaagtacttacattaggtttatgaaaaaaaagagatttaaatctgaaagtgacaaatataatttatggacaaccaaggaatagtgaaaatattcagtaaaatcataatgaataacaatattggaaagtttaaccttttgctttaaaaacctttgttataattaagctaccatagtgaacagcatttataaacaaaattataatgttgctatatttttcttgcacaatggcttttatttatttatttgttattttactttaagttctgggatacatgtgctgaacatgcaggtttgttacataggtaagcatgtgtcatggtggtttgctgcacctatcaacctgtcatctaggttttaagccctgcatgcattagttatttgtcctaatgtccctttgcccctgccctcagataggacccggcttatgatatttccctccctgcatccatgtcttctcagcacaatggcttttaaatttcatttttggataggaatattaagcattcactattttcatgttggattttgaaactgcatttttcttgcaacaatgtgtttcttctagtaaggataatgcagttggtaaatcacatttaatgatatagacaaatgttttgagaggtagaaggagcagaaaacattattcatcttagaggtgttcatagtataaaattacaaagagatcataaaatattgacaagaaatgtaaaaatatagtatgtagaggagtaaatgaaagagataggagatagagaaggttccagcattggattgtaaattcttcctgagaaggatggtcatttttgtttcctaatatcattagtgtctggtattgtacaaagaagagattgataaatgttttttgagtaaatgaataaaagaattcctagagaaaagtttgacaacagtactcgaggaaaggagactcatgaaacaaggaggaagatttttcccccaggcccctgaaaggtaaaggccacagaaacctgaggggagaaacggcacatgaatgaagggtgcaattggaatactaggtgtcgccccaagccttgctccaagggaaggcagataaaaagcacattttttagaaagccaaatttagaatcagtcagtgttttgaaaatatctaagacgagtttttctttgtatttttgaaagcaggaccaccacttacaatagggcttggaagtgacatagctctcatttagttcactccccatctggttagtgtaggagtttcttctgtggcatccctaccacagatcttaagagagaatttttagttatagtagaagaatgttcaaatgtaagtccttgttttattatcccatgttgcaggaaaatgggtacctaggaagatgctcagggtgtgagatggaaatctattggagaaattatcaacactgcgaccatttgtatttggcctcatcagttgtaggtgtctaagtatgatattatcaattctcattgtcttccttctcctgcagatggaattatctgtagtagaattttttaaacttgggggtggagctaagatggccgaataggaacagctccagtctacagctcccagcgtgagcgacacagaatacgggtgatttctgtgtttccaactgaggtaccgggttcatctcactgggaagtgccagatagttggtgcaggacagtggttgctgtgcaccatgcataagctgaagcagggcgaggcatctcctcacccgggaagtgcaaggggtcagggaattccctttcctagtcaaagaaaggggtgacagacggcacctggaaaatcgtgtcactcccaccctaacactgcgctcttccaacgggcttaacaaatggcacaccaggagattatatcctgcacatggctcagagggccctatgcctatggagcctcgctcattgctagcacagcaatctgagatcaaactgcaaggcagcagtgaggctgggggaggggcgcccgccattgcccaggcttgagcaggtaaacaaagcggccgggaagctcgaactgggtggagcccaccacagctcaagtaggtctgcctgcctctgtaggctccacctctaggggcagggcacagacaaacaaaagacagcaataacctctgcagacttaaatgtccctgtgtgacagctttgaagagagtagtggttctcccagcatgcagcttgagatctgagaatgggcagactgcctcctaaagtgggtccctaacccccgagtagtctaactgggaggcaccccccagtaggggcggactgacacctcacacggccaggtactcctctaggacaaaacttccagaggaacaatcaggcagcagcatttgcggttcaccaatatccgctgttctgcagccaccgctgctgatacccaggcgaacagggtctggagtggacctccagtaaactccaacagacctgcagctgagggtcctgactgttagaaggaaaactaacaaacagaaaggacatccacaccaaaaacccatctgtacgtcaccatcatcaaagaccaaaggtagataaaactacaaagatggggaaaaaacagagcagaaaaaccggaaactctaaaaatcagagcacctctcctcctccaaaggaatgcagctcctcaccagcaactgaacaaagctgaacggagaatgactttgacgagttgagagaagaagtcatcagaagatcaaactactcccagctaaaggaggaagttcgaaccaatagcaaagaagttaaaaactttgaaaaaaaattagacgaatggatagctagaataaccaatgcagagaagtccttaaaggacctgatggagctgaaaaccatggcatgagaactacgtgacgaatgcacaagcctcagtaaccgatgcaatcaactggaagaaagagtatcagcgatagaagacgaaatgaatgaaatgaagcgtgaagagaagtttagagaaaaaagaattaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaatgcaggccaacattcaaattcaggaaatacagagaacaccacaaagatactcctcataaagagcagctccaagacacataattgtcagattcaacaaagttgaaatgaaggaaaaaatattaagggcagccagagagaaaggtcgggttacccacaaagggaagcccatcagactaacagcggatctcttggcagaaactctacaagccagaagagagtgggggccaatattcaacattcttaaagaaaagaattttcaacccagaatttcatatccagccaaattaagcttcataagtgaaggagaaataaaatactttacagataagcaaatgctgagagattttgttgccaccaagcctgccctaaaagagctcctgaaggaagcactaaacatggaaaggaacaaccggtaccagccactgcaaaaacatgccaaattgtaaagaccttcaaggctaggaagaaactgcatcaactaacgagcaagataaccagctaacatcataatgacaggatcaaattcacacataacaatactaaccttaaatgtaaatgggctaaatgctccaattaaaaggcacagactggcaaattggataacgagtaaagccccatcagtgtgctgtattcaggaaacccatctcacgtgcagagacacacataggctcaaaataaagggagagaggaagatctaccgagcaaatggaaaacaaaaaaaggcagtggttgcaatcctagtctctgatacaacagactttaaaccaacaaagatcaaaagagacaaagagggctattacataatggtaaagggatcaattcaacaagaagaactaactatcgtaaatatgtatgcacccaatacaggagcacccagattcataaagcaagtccttagagatctacaaggagatttagactcccacacaataataatgggagactttaacaccccactgtcaacattagacagatcaacaagacagaaagttcacaaggatatccaggaattgaacacaggtatccaggaattgaacacaggtatccaggaatctccaccccaaatcaacagaatatgcattcttttcggcaccacaccacacctattccaaaattgaccacatagttggaagtaaagcactcctcagcaaatgtgaaagaacagaaattataacaaactgtctctcagaccacagtgcaatcaaactagaactcaggattaagaaactcactcaaaaccgctcaactacatggaaactgaacaacccgctcctgaatgactactgggtacataacgaaatgaaggcagaaataaagatgttctttgaaaccaatgagaacaaagacacaacataccagaatctctgggacacattcaaagcagtgtgtacagggaaatttatggcactaaatgcccacaagagaaagcaggaaagatataaaattgacaccctaacatcacaattaaaagaactagagaagcaagagcaaacacattcaaaagctagcagaaggcaagaaataactaagatcagagcagaactgaaggaaatagagacacgaaaaacccttcaaaaaaatcaatgaatccaggagctggttttttgaaaagatcaacaaaattgatagaccactagcaagactaataaagaaaaaaagagagaataattaaatagatgcaataaaaaatgacaaaggggatatcaccaccgatcccaaagaaatgcaaactaccatcagagaatactgtaaacaactcgacgcaaataaactagaaaatctagaagaaatggataaattcctcgacacatacactctcccaagactaaaccaggaagaagttgaagctctgaatagaccaataacaggctctgaaattgaggcaataattaatagcttactaaccaaataaagtccaagaccagatggattcacagccaaattctaccagaggtacaaggaggagctgataccattccttgtgaaactattgcaatcaatagaaaaagagggaatcctccctaactcattttatgaggccagcatcatcctgataccaaagccgggcagagacacaaccaaaaaagagaattttagaccaatatccttgatgaacattgatgcaaaaaaccccaataaaatactggcaaaccgaatccagcagcacatcaaaaagcttatccaccatggtcaagtgggcttcatccctgggatgcaaggctggttcaccatatgaaaatcaataaacgtaatccggcatataaacagaaccaaagacaaaaaccacatgattatctcaatacatgcagaaaaggcctttgacaaaattcaacaacccttcatgctaaaaactctcagtaagttaggtattgatgggacgtaccgcaaaataataagagctatctatgacaaacccacagccaatatcataatgaatgggcaaaaactggaagcattccctttgaaaactggcacgagacagggatgccctcactcaccactcctattcaacatagtgttggaagttctggccagggcaatcaggcaggagaaggaaataaagggtattcaattaggaatagaggaagtccaattgtccctgtttgcagatgacatgattgtatatttagaaaaccccattgtctcagtccaaaatctccttgagctgataagcaacttcagcaaagtctcaggatacaaaatcaatgtgtgaaaatcacaagcatttttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaacaaaagaggatacaaacaaatggaagaacattccatgctccatgggtaggaagaatcaatatcatgaaaatggccatactgcccaaggtaatttatagattcaatgccatccccatcaagctaccaacgactttcttcacagaattggaaagaactactttaaagttcatatggaaccaaaaaagagcccacattgccaagtcaatcctaagtcaaaagaacaaagctggaggcatcacactacctgacttcaaactatactacaaggctacagtaaccaaaacagcatggtactggtaccaaaacagagatatagaccaatggaatagaacagagcccgcagaaataatgctgcatgtctacaactatctgatctttgacaaacctgacaaaaacaagcagtggggaaaggattccctatttaataaatggtgctgggaaaactggctagccatatgtagaaagctgaaactggatcccttccttacactttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacaaaatgggagaaaatttttgcaacctactcatctgtcaaagggctaatatccagaatctacaatgaactcaaacaggtttacaagaaaaaaacaaccccatcaaaaagtgggcgaaggatatgaactgacacttctcaaaagaagacatttatgcaaccaaaaaatacatgaaagaatgctcatcatcactggccatcagagaaatgcaaatcaaaaccacaatgagataccatctcacaccagttagaatggcaatcattaaaaagtcaggaaacaacaggtgctggagaggatgtggagaaataggaacatttttacactgttggtgggactgtaaactagtctaaccattgtggaagtcggtgtggcgattcctcagggatctagaactagaaataccatttgacgcagccatcccattactgggtatatacccaaaggattataaatcatgctgctataaagacacatgcacatgtatgtttattggggcactattcacaacagcaaagacttggaaccaacccaaatgtccaacaattacagactgaattaagaaaatgtggcacatatacaccatggaatactatgcagccataaaaaaggatgagttcatgtcctttgtagggacatggatgaagctggaaactatcattctcagcaaactatcacaaggacaaaacaccaaacaccgcatgttctgtcataagtgggaattgaacaatgagaacacatggacacaggaaggggaacatcacacactggggactgttgtgggatggggggaggtgggagggatagcattaggagatatacctaatgctaaatgacgagttaatcggtgcagcacaccaacatggcacatgtatacctatgtaacaaacctgcacgttgtgcacatgtaccctgaaacttaaagtataataataataataataaagaattttttaaacttatttcgttaaccatttggtttttgttttgtctcctggtagcttagaatattctttccatttatctggtattgcctcagacccaaatttgaatagttaaatcatttatttagtgctcgtggtctcagagatatgacaaagcaaagatctctttcgacctcagtttcttaaagcctaggggaacagaaaagatttgagggacagtcaaaaactttaaagacttgaggaattaggggttttgctcaaaccagaaagcatttctcttgactgtagaatgggaggggagaagaaaggggtgtattttgaaaagagacctcggtgggttctggggagaggagctcggtacctcaagcctagttagatccataggatttggaaaaaccacagatggatctgtgggctttgagggcagaggggattcacagatccctaggaagtggtaggaccccagaggacacaggcagaacacaggacagagtgggttcagtagaggcatataggatcacagatagccttgcagaattcccaagcaagaggccagccagcacggcagcacacggccaagggatcccagggctagagaggacatgtgaacagtgtccgagtggagtgatggatgaggaccccctggaacagtgaacattacagaacatgtctcagtagataactgatatcagagatcagatggcacccacttcccaggctttggtgctgtgtactctcctaggccttagttctggaaaacgatgggtggttacctcaattgaatgagatttggttagtgccatccagatagaatggggaagaaaaatataaattttgctgagcaacaaaatgagaaatatttagaatattgtactacttgtcaacttgtgaatttgtggaccataattgataccatctatatatcattagtgtttctgaaactatgaaactagtttatgcatctggcacaacaaagaaaacatattttgctcatttctactcccccaaaaaaaccaaataaacaaacctagaaatgtaaaagagtatcatgcataaagtgaatattctcggtcccttcttacctcataacttatacgtgtacactggttctgctccatagatgtaagacctgtggatgaatatttttcacccttttaggggccattatagtatcttcatttgaggttggaaaacagaagaaaatacaattctacttgtaccagtttaattttcatattaagattttatacttattttaaacaaactatgaaacttaccaagttcccccatcatgacctgcctcagcaatatgaaaatatttttgcagaactctgaccagaaatatatggatttttttgttttaatgtcactcatgcagcttcaatgatgcatgaagttatgaaaatctcgggagggggagaaatctactaatgcacaagtgatgttaattcaacaaggggccatttaatgttgtttaatgactggaaattatgttaaggtcaaataaactgagggccctggttcaaaagacagtcgcaagcaaactggaattatagtaagcaagatagttcctcccagctgcttagattttcttttcctggaagaacttaatatatccttcaatccctgaattgcggtggagtttgaaaacgaggaaagaataacaggagactataaattgatttgatttacagtaatgcaagtaaaagatctttcatttcattttcccttggagaaacaatacttctatcagtatagacatctattttgaagcaattctgcaactacatggcccataaattcctcataatatatttcacaattattaataatgataactttagtctatgaaatggaacttttggaaacggttgaatcactgaaggtggagagatttctgctttcattatgggctttatcttctgttatcactcaaggcattaaaatgaaataaaatttaaaattcagtttcttagttgcactagccacatttcaggagctcagaagccacacatggccagaggtttttgtctggataatgcagaagtagaaaatttctgtcatcaaagaaagtcctattggacagtactgctccacatctatggcaatatatcaggaggggtgaaaatctgaaatgttactgccacagttttattctttactgactacgtaaaacaaaacttttctgttaagagcatgtttatagtaacaccatgactaacatactactgattttccagttctgacgagctgactggccgactgaatgaatttttactgatcttaatgtagtatgaaaggaacaactaaaataaaatatggtttattctgctgatttgaagttaatgagggttttttatatgaaaatgtaaatgttgattacatattattcttgtcttagcatgcagatacaaaccacagttataaagaagagaacccaattcttcaccaaaattttagtttcttttcttttttttagcatttattctgtctgtactaaaaaagaatttgtgaagatgctagcacaaatatttatatatactcagtgtatttaaagtgtcttcttatacattttgtaatcaaataatctgcaatgttctgtgtactcacataaggaattttggggtccaacgtatttgaagttttcatattgagtcagttgagaggccagttcattttagagactaatctttatgtctgtaatctctactttttcctgtgtttatagttgaaatccagttctactgaaagtttgtggaataatgacttacactaaggaagtgagtcagtgtctccaagaaataaaaggattaaattctgagtatagtaatgcccattggtttctaagtgtagaactgtgtggtgagagagagaaagtcgttatggagggagagaagagggagagttgttatggaggaagagaaagttgttatggaggaagctgtatgaatcctggaagtccaaatacactcctaaatgtatgatgactttgaagatgggttaaaaaataagatgtacttttttagtgacataagtatccatacttaaaatgagaataatgtagattctctacttatgtaagtagaggcattcttatttatttggaagatttgttaagtctagtatctatttctaaatcaggttttttttttttttttggtattggtatttctcctaatgctatccctacctcccctagcccctgaccccagatatttttaagaggaactcttttgttgttcatttgagtaagcagtgaatgctattttctctttactttttaaattaaatgcattttcatcattttgagtttttaaaaaaatgttcaaaatatagttaacagcatataaattggtaccactctttcagcaattgctctacacatgtgaaaaagtcaagccacgttttcctaaggtacccattctctttcaaaacattttttaatgcctgcgattctctttttcctagggctgatggggtaaaatgaagatttggtgaaagtgaaatatggtcaaagtttcctctcaaacatagaattttatggcagtaaaagaaaagcaggagtcactatatttatgcatttggcttcctgattttaagggtgagatgatgtttcttaaccttcagtagcagttctcttttgcattgcagctgtaatatatgtattgtagttagcgattgttacattcaaattcatttttaaaaaattttctagattgattattcaaaagccctgtgagaaaattactcgccttatgttttcttttgaaacatacttaaaaatctaggttaaaaatataaacctcttaagaagaatgaatatgtggttatgtaggatacttcctggaaattcttaatggcctttactaacaaaaaaaaatgcaatactgaagcctctgctcccaggctcaggtgatcttcccacctcagtctcccaagtagctggggctataggcgcatgccactatgctgagctaatttttttttttttttgtagaggcgggggttttgccatgttgcctaaatttgtgagctcaagagatctgcctacctgggctgcccaaagtgctgggattatagacatgagccactgtgcctagccagtaatcttaataaacagatatttcattaataacttttttctaaaacaatttttatgtgtatttattttaatgattaaaatgctatgccttaagcaatacatttatataagatatagcagtaaaattatgcatttggaacactaatcttagaaattggtgtattggtttaattactttgatttattaatgtctatttctgtgcctgatacttgagaatgaaaggaagtatatattcattgaacatggtacatagtacatattctgtgtatcagatactcttccaagtcgctttatgtatgttattgcatttaattctcacataaactttacagttattaatccattttacagacaaagaaaccaagagttaaagaggttatgatttgcccaagagtattcagttaaaatataccaatggtaagagacaaaccctgagtttgttattctagagccttcactcctaaccactgtattaccgaggtcagtagtgtcctcattatacaaggaagaaaaaagagactcacaaaaaacaagtaacttgtccaaaatagagtaaatggtggaaaaagttttcaactgagtctctctaacttcaaattttagcccattttactatgccacacaggggttgacaaatcagattggggaaagaagaggttatagaccatcagaagtgcataagaagggttcataggataggcaaagacctgcctggagaacccatgtctgtttaacctttcagtgcatagaaacttgccatatgggcttagaagtcagcttgtgtctatgggccctttttctatagtgatactgagaacactctagaagcaatgatcatgaatgctcttgcataaggcgtgtattttcacttcagtaagaaaacagtgaggcccagaagattgtttgcaggtcagtaattgttgcttgtggtgcttgtttggagtcaatacggggcctggtcttctacttgcacatgcaggagttttcagcagccagattggcctggtggagtccttagagaatttgagatgtcacttacgatgccagataccattctgaggcaggagtctggatctgctgcaagaaatacagctttaaaaaactgtgtgacaacaagaagaggcacatacacttgaaaagaagaccattctttttattgaaaaaatttgtacctgtgattttctgatctgctggacattgacagaatgttacactaactccaggctaattgttcaatagttaaagatgaaaagtgaggagtaacataggcagacttttataacacatgatgatgaacaatactttgctgatgatctctgattggtaggttttacgacaatttggatagatgtcctcttgtttttaattctttggtgagtgggaagagcaaaggaatgcagaagagaggcagagaagtttctgggaagggtgaaagtatgaactagtagtagaaagagaaaaagactgagttttacagggaataagagatattgacttaattccagaaaacatgaaaagaaagtttggatatcccaggtggaatatgcatctgttggctttgttgatttttattatccttcaataatagaaactgagacacaggagaacagttttggaacattaaatgtggagctatttctatttaaaaataaatgtaatacggtagcctccccttttcctcagggtatacattgcaaaaccctcagtgtatgcatgaaactgtggatagattagaaccctatagagactatgtcttttcctaatacaattacatcatatggggcaagcagtatatacagcatagatatgctgaacaaacggttgattcaaatcatgccaggtgggatagtatgggacaatgtgagatttcaccatgctgctcagaacagcatgcaacttaaaacttaagaatttgaatagaggtttatccaaacttttatttctggaattttccatttaatattttggaccgttgtggatgaggttaacttaaactgtgaaagggaaacttactattgtattttatgaatttgttaaagagaaatctaaacatgcttcttttttattttttatttttattgatgcataataattgtacctatttatggggtacatgtggtattttgatacaagcatacaatgtgcaatgatcaaattggggtacttaggatatccatcacctaaacatttatcctttctttgtgttaggaatcagaatgtttctaacacaaagaaatgataaatgtttgaggtggtggatattctctgcagttattttgaaagatacagtaggttattgttaactatagtctccctattgtgctaccagatattagatctaattccttctatttgactgtatttttgtacccattaaccaacccatctttatcctttcgttgtccctttcattcctagcctctggtatctgtcattctactctctacctccacaggatcaactttttttttttggagacggagtctccctctgtcgcccaggctggagtgcagtggcgcgatctcggctcactgcaagctccgcctcctgggttcacgccattctcctgcctcagcctccggagtagctgggactacaggcccaccaccacgcccggctaatttttttggtatttgtagtagagacagggtttcaccgtgttagccaggatggaggatcagctttttaaaccctcgcatgcaagtgagaaacatgtaatatttgtctttctgtgcctggcttatttcactaaatataatgccctctacatccatccatgctgttgccaattttattatttttttattgctgaataatattccattgtgtatatataccatatctttattgctgaataatattccattgtgtatgtataccatatcttttttctttctctctctcctttctttccttccccccttccttccttccttccttccttccttccttccttcccttcccttcccttcccttcccttcccttccttccttccttccttccttccttccttccttccttccttccttccttccttccttctctctctctctctctctctctctctctctctctctctctttctttctttctttctttctttctttctttctttctttctttctttctttctttctttctttccttttgatgaggagtcttgctctgtcatccagactggagtgcactggcgctatctcagctcactgcaacctctgcctcccaggttcaagcgattctcctgcctcagcctcccgaatagctgggattacaggcacatgccacccttcccagctattttttttgtatttttagtagagatggaatttcaccatgttggccaggctggtcttgaactcctgacctcagatgatccacctgcctcagcctcccaaagttccatttatctagtgatggatgcttaggttgatttcatatcttggctactgtgaattatgttgcaataaatatgggagtgcagatatgtcttcagtacaccgatttcctttcttttgggtatttacctagcagtgggattgctgaatcacatggtagttctattttagttttttgaggaatctttatactgttttctatagtggctgtactaatttacattcccaccaacagtatgaaagtttccctttctcttcatccttgctagcgtttgaattttaaaaatctttttgataaaagccattttaactggtgtgagatgttaccattttaattgaaactttgatttgcatttccctaatgattagtgatattgagcatttcctcatatatctattgcccttttgtatatcttcttttgagaaatatctttacaggtcttttgcctattttaaaaattggattattattatttttttcctgttgtttgagttccttatatattctggttattaattccttgtcagttgaatagcttacaaatattttctcccattctataagttgtctctttactttgttgattgtttattttactgtgcagaagtgttttagtatgatgtgatctcacttatccatttttgccttggttgcctgtggttttgaagctttactcataaaacctttgcccagaccaaggtcctgaagcttttttgcaatgttttcttctagtagttttatggtatcaggtctcacaattacacctttaatccattttgattttatttttgtatatggtgagggataggggtccacttttgttcttctgcatatggatatccagggttcccagcaccatttattgaagaggctgtcctattcccaatgtatgtacttggtgcctttgtcaaaaataagttgactggatatgcatggatttatttttgaatgtcctttatccaaactttatgtctagaattttccatttcatatttttagaatgatgttgaccaagcataactgaagccatggaaagagaaactgtggataaggggaacactattatattttataaatgcttaaaaatttttcaatgtttggaagctttcttaggaggttctcactgcagagatcaggaaatatttattaaccacccactttgtgaacagcagtgtgttggttatgatatggtttggttctgtgtccctacccaaatctcatcttgaattgcaatcatatatgttgagagaggaacctgtaatatccatgtgttaagggagggaggtaatttggccataagggtgatttcccccatgctgttctcgtgatagtgagttctcacaagatctgatggttttataaatatttgacagctcctccttcacacacatttctctttactgccaccttgtgaagaaggtgcctgcttccccttcgccttccaccatgattgtaagttcctgagacctccccagtcgtgtggaactgtgagtcagttaaacctcttttctttatgaattacgcagtcttgagtagtatctttctagcggtgtgaaaatggactaatacaggttctttgaaggcatattgaaaaaacaggatataagggggtctgcaaatcaatagtgaggtaaaatcgtcaaacatgaagcaaatggaggcatgaatattcaagatagaatgttttaatgatatatacattaaacattatgaagttcagaggtaagggcagcttccctggaggaaatggaattgaagctagatcttgatggatagataagttttggggaggaagattcacatcatgtttgaatggggatgtttggcaaagaagagattgcttttaggcagaagaatgatactggggtcttgaagaactgaagatgtctgagatgctcatagggcagtagccagctggttcttagtgcattttggggaaaatcgtggagaggggaaggcctgagattgcatagtgagagtgaggcccacctggtgatctctattatggtcaaggattaggatcccctgaggaaccacagaagctaccagttattcagagagtggttaaagaacaaaaggaggatttcttttcacttgagggcactcatctaaattaactttttgttgacaaagaaatgagtactcagtcctttcatgcttcctttactgaaaggtgatagaatctccttcattagttcataatccaagtgtaagggaaacatattattttaaaattgttacttatagttaaaagtttctcagtgggttggaaatttaggctagattcagatttctttcagattttttttcttgtagcttttgtaaatattgattcaccctagaaatgagttatgggtaggagggatctttaagaaaatttttttactatggaacatagcattccagaaaaacctcatttctattgatgaatggctgttggcatacagaaacctggcatgtggtcgaggagaagggatacagctgacatgagaaaagcttgagaaggaaactataatcccccttcaaattcactgctcattagaggagctaaaatgattaagcagctggaggttttgatgtatgaggaaagattaaaagaattacatgtgtgtaggttggctaaagagctaaggagtgtgtgtgcctgtgtgtgaggtggggatctgatagccatttgcagataattgaaggcataagccccccaaaaggagagggattgtgaaggtggtccttaggggattatctaagggtaatgaatgaacggaagaagagaaagaaaatggtttcatcaggaagactttcataatgggtgagatttaagaggccataaaataatctcccagaagaggtggtgaaattcccatctcttgagtcatttggaggaggcctaaaaagttttggaagtgtataatgctaccctggtgggggaacagatttagtaaccaagaccatcctgggtcctgatgttttacagctccatttttaagatgaatcaattgataaacaataaatttggaagcttcccaggaactgagtctgtctcatctcactgataattttcttcaagtaataaagacacattccatacctcttcctcgcttgatttctacccattgtccttgacattgtattatttcttaagggacataaaggcccaatgatggaggaattgcaggattgaaagggttagcagcaagtcattcagcaaatggcaatattaatacagcatccctgcactgcagtctcctttccaaacaggactgctctctgatacattgtcagaactccttgcattgtgttcttcagggttcctcagcattaatcagcatctggactgtgccactcttgcaaatgaaattggtcaagaatagcctttccccagtatcatgatgaagcagaatttttttctggtgtcttttgataatgagaatgacagtattctatctttatattaatagttcacagcaactaaaagaggtgggatctcagaacacttcatttaatgccaatagaattgtaacagaaaccttatgaccttgtatggtccttttctgtgatctcacagtttctttagtttttcctctatgtgagtaataataaatgattcttacacaaagatttatgtacacatatttcttcacagtgttacttacacaattaatgctaagaaacaccctaaatattcaatatttggtaaaaagtctttctttatgtccttatagtagattgttacagctgtgaaactcatggttttgaagaatatacaatgacatctaaaaatgtgcatgataatgttggaagaagcaagcaggacctacaaatacaatataattctaaatgtacttagataaaaagatagataaatagacatgtatcttgcctttctatccttgaatgatgaaattaagagtaatgttttcttcttcgtactgttttacatgttctgcaattaatatatattatttaccaaatctgttatttaaacagatttttcttttaaattaaaaaaatgagtgtttggatgcaagtgttttgcaagaagcaatagataacgtgcacagagctcaaagtgaacttttccacattaaaaaataaattaaataaaaacacatgtggagcatctgtacaatttaaaaagtgagaaatcaatttttggatttttttcatccaaaatatttttatgaactgaaactagaagaaaattaagatgagtttgagtcagcatttcacaagctgctccaaagtactccagtgtaccaaaatattttataatatttaaatattagacattttaagcattaacaaagatggatttctatttttcttgacctattagagactttaacatggcaatgagtatttctttttttaaatttaattttattttattttaagttccaagatacatgtgcaggatgtgcaggtttgttacgtaggtaaatgtgtgccatagtggtttgttgcacctatcaacccatcacctaggtgttaagcccagcatccgttagctatttatcctgatgctctcctccttccaccttccctgcatctccaaccaacaggccccagtgtgtgttgttcccctgcctgggtccatgtgttctcattgttcagctcccacttataaggaagaacatgcagtatttggttttcagttcctgtgttagtttgctatggataatggcttctagctccacccacgacccagcaaaggacatgatctcctttctttttatggctggatagtgttctatggtgtatatgtaccacattttctttatccagtctatcattgatgggctttcgggttgattccatgtgtttgggattgtgaatagtgttgcaatgaacataagcatgcatgtatctttataatattataggatgatttatattcctttgggtatatactcagtaatgggattgctgagtcaaatggtatttctgttctaggtctttaaggaaacactgtattgccttccaccatgattgagctaatttacactcccaccaacagtgtgaaagagttcctatctctcagcagccctgccagcatcttctgtttcttgactttttaataatcgcccttctgactggtgtgagataatatctcattgtggttttgatttgcatttctgtaatgatcagtgatggtgagcttgttttttcatgtttgttggccacatgaatgtcttcttttgagaagtttgtgttcattatgttcatgtcctttgcccgctttttaatttttattttttgtaaatttaagttccttgtagattctggatattagccctttgtcagatggatagattggaaaaacttttttcccattctgtaggttgtctgttccctctgatgattgtttcttttgctgtgcagaagctctttagtttaattagatcccatttgtcagtttttgctttttttgcagttgctttcgacgtttttgtcatgaaatcttcacctgtgcctatgacttgaatggtgtgtatttctaattcttcaagagaaggatattgcattatgtttaacagtaaatcaatagagggattactgtgaaaatcaggaaaaaaacaaagttttctattattagttttgttattaaattttttcttattatgtttgttatttaacattattgtggaagatcagaattttgaaaaaataaaaattataataattagaaaggaaaaaattatcaaatgaaacaaaattatacttacaaagtaaactcatgagattatcacaaattttaaaatgtgaaagtttattcattcatttaataaatatttacggtgtgcttgtggtgaccctggtactcttttcatcaataaacaaaaaagatgaaaatctttgtcactgaggagctttcattatgttaaactttaaatcttctacaatataataagtttccgtatgtgcacaccaaataatgcaaaaataatctttacacagagttttgcatttgtttgttttttactagaatagaaataatgacctacaaaaagataaagatttcttatacatattgttaaaataatttaaattgatttgatatttttctctaataatataaatcattgttagcatcttttactaatttttctttcatttcttagtctgagatgcttcattcaaggcatagaaaagtatattagatatacacatatgcatacatattctattttattaatctgcctcttttactttacatatgcagaagaaaagggacagatcatttccaagtcatcccaaatgaataaactaataaactggatagccatgatgaagaccaagtggtctagtttttgagtacccacctcttacccagtatgctgtgttaaatgtcagcacctggggtatcattagccattaaggaatttcatgtccttcttcctagggacctagctcaccatctttcttgtcttgttctttttttttttctcctttggcctgcctggagaccatgaaaattgttccctctgtagtgaggatattgagcaggcattcagttcttttgatctcactccagcccacactggccatgcatgcactgagggctgtcatcctacagccagaaaggctgagcaaggtgcctgttccagcggagggcattttctttcctaaaatgggttctgatgtcagcttttgtatcaccctgtctttttcttcccctcatggcataatttctgctctataattgaggttttgatggatcactatcaattttcagaaaatttctttttctctttggctttttagctcacacctgttaagggatcctgccattatttaaaatttgatactttgtccatcataggtgcttgcattcactttgattttcaaaaaaattattgcatcaaaagattatcttatttccccaattttttgtcactcctttgaattttgtggacaaggcaaacgcttcacttgcctaatcttagtcccagcctggctcatttaacagaactagtttactgggcaacctcaaaagaaagcaaaatcatagcacagggtttagtaagtcttttctagtaactataacttaaataaagtttttttttcctattttcctctcatggaggtaaaatagcctgtctgtattttatttccttcagatcacttttaaatgatcttagctggataacaattggagtgcagtccattttttggtttattttgctatttgttaggaaatattatggcacttgttaaccaacaaaatgagtttctgctcattttttgtcttcatctgttgcagtatgttcaagaaagtttctggaatgtggaaggaccacatagttctgaaaaaaaatctaaataatttagtgaagaatctatttgtaaatctcccacataacaaaaaacaaaactcttagacatttttatgttttcagaaattatccttcccagaaacatgttctcttattttatgtaaatgtggagataatagctcttgagggctgattacagaagatgttcgggtgtctgaagacattgggttatttagtgcagagggaggcaatggaggacagccattgtaaatggctttttgggcggatggaagtccattgcatctgccatttaaaaatcataaatatttacatatattcctttggattttaaaggacaatttttatgaaactattgtaattaatcttttcgcggcattaggtctccagattaagtaaaataaaagcagaataagaaaaatctaggcaaagctgaaggccaaagttgggagatttggggtctctctgttctctatttgagtcatgtattcagaagaaggaaaagaaggctttttgcacaaacaggctgagacaaaatatttttgttgactctctacacccaataattgtagtttatgagatgaccagtatggcaggcagcccagcttcactcccaaagtccttggttcaactccaagtgaccattggtgaacaaggtcttctcactgtgttattaattaaccctggcagatctgcaatgttttcattccattggcagaaagtgggcttttccctttgtgttctgttctagtcttggagactgtgcatagctccacgccagcactcgactgaagtcattaaaatcattgcattggaccctgctgctgactgctgatgttgcaacagtcttggaaacagtgaagcttcatccaggtggcatttgttttcttaaaaaaagtcacagaaggtccagtgtccccccttctgttctaaaataatggttagagttttttgttttggtttattaaatttatttgggaatagaaaaattagagaataatgtaccatgatatctgccttgttaatcaccagaagaaattagatttgtggcatataattaacacagggccaaaaagttagaatcacaacactttggaattgtatgtttcaatctccatatacacacatcatcttctttatattatccccagaatctccacttgaatccttttattaacaaagatcttaattactctctgatacagccagtttcacatttagggaagcagtgtgttcaaagacaaaacagaaccttttgagtcaataacacaatctgaaacctggagttgatattcaggagccatattgcatttgggcaagaaatgtagtcaaatctcagtttcctgtctatgaaacaaaatttaaatatctacttcaaagtgttgaaaaatagcttatgttatgtttaattccagtctagcagaagttactaaactgcagtcgctttttttttttttttttttttttttgagacggagtctggctctgtcgcccaggctggagtgcagtggcgcgatctcggctcactgcaagctctgactcccgggttcacgccattctcctgcctcagcctcctaagtagctgggactacaggcatccgccaccacgcctagctaatttttttgtatttttagtagagacggggtttcaccgttctagtcaggatggtctcgatcccctgacctcgtgatcctcccgcctcagcctcccaaagtgctgggattacaggcgtgagccaccatgcccggccacatttcttttttaatacaaattgcagtagttcgagttttgcctttcacttgacaatagttgtttagcctttaaccatgttatcccatgttcttactaggaagagtttgagcaatacagtaggtctgatgctccgcagacccattctaagtgtcattttctgggtttctgtctgctgtgctccagccttgtgccattactaccttttgaaggggtcacactgacttccctcgggaggctgttgccttcccaaatataatgtcaccacaagcatggtacacagagccttctctgtgttctccatgacaaaagcagaatgaagcttacaagttttaatgagacatcactggagacttggggaaacggatggaaatcctagcaataaaaaatttgaaactaacgtctaaaaatgcttgttttgaaatacacaagactgagtcacatgacagagctctcctattggaggcctttctaccaagattctggcttgcctctcaaaggcagaccccaaactcccacctttgctcctggcctgttgtcctgtctcagggccaccctaccactcccagcagggcaggccttactctcacctatttccagtttagtgccttaactgcttgtgactttgaggtgagaagatgtttattttctcctgagtctcaaagtcctcaattctgctccagagtttaactgtacctaggatgatgaactgtggaaacttctatggtatctgggggaaatttaacattcctctgttccctcagtaatgtggaccatagatttcttatagaatataatattctaatgctaatattttccctgaagtcagtctttcctctatatcaaggcgaacaccaggcctacatttttttcctgctaattttattttaattttacagatatacccatactcactccttgacacacttatatgagtatagaaaattcaaaattgatacttatgaaataaacatttctttaaaataatgtcagtaatcaccactttaaggtgaagactgtactctgatcattgtttttccttctgctttcagaggaatgatcaatcactaagaaaatggccaattttcctgcattacacagagtggtttaactgcttaggtaacatgtcacaatttttcttctagaagatggtttttacttagtttttaacatataaaaaatttattagggtggtttatctaggaaaaaatgagtaattttatcttaatatttaaattaaagtctgtttctcacaacaaaaatgctgctggaaatgtgtaattgagtctcttctcttttcatcatctatttagtaacacaagactcaattggttctacatttaaacttattggcacaaaccaggtgttcaataatttctatttccctttcaaatatttaaaaactcttccttcagttgtgtcaaacttatttttctaaaatttttgttcgtggatcctatttctgtgctttgggaagctatgctatttcataactttcaaattacagctttgcccaaaggttgggtttttgcagctggaaaagggcagcacagatttaaccttatgctttagtgagttttgaggcacaaaaggtgccagaggaaaatagacactcacacacacctacattctgggaatgaaataaagaactgggctttttacagtcctgttttacttgaacaggagggagagacaagaaagtttgatggtaaagtcctgctgactactttggaagggaagatctgtagttcttggtcaaaaactttattcggtgcatgaaatgttacacatttcatcatccagaaatttggaccaatccgaggcacaacgatttgcacaatttctgtaacttttctctttgtagcttctttctctaccaatatttgccagagagaagagggccttacacggagggtcttcctcagatgccacattgacgctaaggatgggctactgtctttgcatctcatcactttacttaacaaagtgtcactccctcgaagtcctattagccatctatctctcatccatccatccatccatccatccattcatccatacagccattgattattcatgatctggtcaactctttgaatgtcttggtagcttacactattactcttcttaaaatgatcatgtcttaagctatggaattgatctctataaggattcccttttattttattctattatataagctgccctgttcactttcaagcatttctttcaatatagacacagatggcccattgttaaattgtagaataactgcaagctatgagggatagcaaaaacagtagatactattttcattatttaaataatttccacaagttagatttaatagatcaatagggacaaatataaaatttaatagaagtttacttgaaaaaatatagacctatatttttgcttaaaggattaattatagatacaagttggggtaataagactaagcggcagaatctataaaagagatttcagaatttttgttgactatatttaattctataataaggcttttaaaattatgccattttagtctacattgtaagaggcagtaacatctggagaaaaggaggttttcatatgcctctctgtttgcctagacaagacttggaacattgcacttacttctgggtagtttgctttatggagatattgacaaacaatgtatgcagagcagagtgaataaaatagtacaatcacggaaggactaacataggaggcataatggaaggaactgggtacagttagtgggaaaaagagtagacttatacagatatgacccctactttaaatatgtaaaaggctgttatttgatatagcaatatgacaaaaaccttaacattttcaaatctgggtttgaaacacagctttgctatttatgtgctctcaggcaagttatttaatctctatcagccctttttattatcaagaaaacatagggataatagaagctaacaacagctcgggttagtcatgaagattaagtgaagaaacctaggtggaacgcctgttgtcatgcccggctcatatggagtcctcagcaagtggtagtgagagttcctgtggttgtttttgttaatattctagatagcagaaacaatatcaaagagagtaaattacaaggagattgcccttaatatgtatgagaatacagtaataaatttattaataagaaattaatataagaaaaatgtttctaaaattatcaattgataataaatagtaagctctccattgccacaagtgtgggaaccaagattggataactgcttctccagtgttaagtggtaactggactgtatgaactctctggtgcttttcaactctgagcttctacaaacttctttgaacaggatgtttagaagcaaaataaattatgatttgtgcacaattataagaattaattttctggatgatattatttggcaaagttataacttaaaattgcttcttctgctctaagcccagtttggcttggacttccagagcacatttgctatttattaatatgctatcagacaagttactatcaggcttcagcaaagtcttacttaattgggtatactttttttgttgttctttgcaataatattcagaaaatatttaggatgcttcaaaatgaggctttaggttgaagaaaatctaaatttggaaaagtaacacactttcaaaataagccttattttagtagaaatgaaataaaatattaaatattttaatagaaatgaaatacagcctgaccaggcttctcctggcataaacattaacactctaaaaacacacagatattggcaataaaaaccaatgcttattattattaatatatttattacttttattttctctaatattttctaatgatataaacaaatgccattgttgataattacagagaaggttataataaaatacatggcaacaacaatgatgatgtgtcttatcatctcatacttggttagatgaaacattattggatttaagaataaatgttttaacaaaatttgttatctatgtaataggcaattaataaaaaaaaattgtgtatctcaaagtctattcatttacccctcttaagaacagaactactattaagacttgttgatcgtgaactgcatttttatatcatgtcctcataaagactctgtgccatggctgagagaagaaggttttagaaagctacccttgctggtctgcctttaggtaaatttaaaatttctgtcttccctgggttgctttctttttttcatttattctacatttttttttccagaaaatacatttatagtagaaaacccaatgaaattagtgaagactggaatacaatttattcagtcgtaattaccaaataatgagctgcaatccagggcaaatttcaaaagtctttttaagggaaacactaaaattattaacaaatgcaaagtaaaacattaagtatattacttcttaatgaatgtgtgagacgtgtcttcaaaataatcctaaaggaaacaagagagtgtaagaatatgaaggtagcctgaaaagacttatttttctctactaagtgatctgcttcctaggaacactttggttattttcccacacacactcctggtcacgaagaaaagagtacaagaaaagagaccatttggattttgtgattagatagagacttttcctgaagggttgcttctgaaaaaaagttgcaatcattaagataacttaggggtagccttaattgtatgcttccttctatcagctctcatctctagagatctgcttactttgtagtggaacctaaatgaactttcagatacactgaaacttgaaactttcactcacattcatattattttcaacaggaaaacataggaaactagaacttttcttgctcccaactcattacatttaaagtgcaccttggtcttcagggcaaagtgagtgttaaattcatattttcacatatatgctttctataagtatgtttgaagatatatctttgatatattgctgttgcttttatgtaaacataagatccaattacctcatatatcaaacttgttatgtttattgatattgcactcttgttctaatattttttactactctgaatatttatcccataagtctattaatattttatcatgtcagatggacaatgattaaaaataaaaccagcatctatctgttaacccaagctcctttcttcactttctttcaatctagcatcaaacttaaaagcatgtattgcactgctcacttttaagtttataaagttaatttgactatttaaaatagttgaacataatgaaaaaatgaaaactctaagaataaagacccacccaaaactctcacaagagcagaccaattacacatacatataaaaacttaattgcattatgcccccaaaatattaagcaagtaaagtagaagcatttagataaaaccttccaactactttatgtacagcaactcgtatgacttcttttttacttagaattcaatctattgagttccacaataggaatcatagactcatgacattgcattagaactaagcttaacttgagtattttcactctgaaaaatatatccaagacaaatggctttgtttgtacaccaaaacacatgggaattttacttaaaagagaaaaattgaaaaaaaaaaccagtgccttcaacagtaaaatggataattgcaatatactcattaaacaatatgaaatacctataaaaataataaactgttgttataagcagcaacttatataaatctcaccagacatagtgatgaacaaagcaaccagaaacaaaagagtgcatattaaagaagaaatcacaagaggaattagcaaattaaaaacaattcatttgagataaatgaaaacaaaaaacacaatacagttgatccttaaacaatacgcgtttaaactgcatgggtccacttagacacagagtttcctgtgctgccgtcacccctgagacagcaagaccaaccccttctcttcctccttctcttcaacctactcaatgtgcaagcgacaaggatgaagacctttatgatgatccactgacacttaatgaatagtgaatatattttctctttcttacaatttaataatattttcttttctctagcttactttattgtaagaatacagtacataatacacataacataaaatatgtgttaatgaatggtttatgttatcggtaaggcttctggtcaacagtaggccattagtagttaagttttcaggtagtcaaacttacacatgaatttttactgcgcagggggttggcacccctaacacttgtgttgtttcagggctcactgtatactaaactttatagaatgcaactgaatcagtgcttacaggaaaacttagagctgtaaacgtctggattaaaaaagaaagatcttaaatcaataaccaaaactttcattttgagaaagtaaaaaaagaagagagaactaaactcaaagcaagcaaaagagaggatatgttaaagattagggtcgaaacaaatgaaatagagagttaaaaaatagagaaaattaatgaaaccaataactggttctcaaagtcctcaataaaataatagcaaaccgagtccagaaacattgaaaaaagaatacatatcatgagcatgtgagatttatctcaacaatgcaaagttggttgaacatgtgaagatcaatcaatgtaataacactacattaacagaataaagaacacgaacacatgataattttaatatgtaaaaaatcatttcacaaaatctggtatcatttcatgattaacaaaaaaacacttaacaaactcagagtagtagaagggaacttgacttgataaaaattatgtacaaaaatccctcagctaacactatatttagtggttaaagactggttgctttcccccaaaagcagaactcaaaacaagaatgactactattattacttctattcaatattttactggcagttctagccaggaaattagtcaaggaaaagaaatacatcttatcagatgcaaagaaaacgttaaaccatctctctttgtagatgacatgatcttgtatacagaaaatcccaagaaattgactataaaaacctattataactaataaaccagtttagcaaagttgctatattgatcttagtaaataagatcaatatacagaagtcaatatttctatataccagcaataaactatccaaaaataaaattgagaaaacaatttcatttataatagcataaaaagcaataaaatttttagaaataactttaacaaaataaatgaaagacttccatgctgaaacataaatcatcattaaaagaaattaaagaagacataaacaaatagaaagcatctatatttaaggactagaagataatattgttaagatggcaatgctccccgaattaatctacagattcaacctaaacgctatcaaaatattggctgacaactttatacagaaatgcaagggaccccaaattggcaaaaacaatcttgtaaaagagaaacaaatttggggaatttacacttcctgatttcaaaatttactacaaagttacagtgattaagagtatgatgctaacataagaatagacatatagatcaacaaaggggagggaagaatagaaaaataaacaaattgttgtggaacaactagatctatgtacgcaaaagaataaaattaaacccctgccttgcactgtatataagaattcactcagaatgagtgatagataggaatgtaaccgctaaaaaccctgacacttctagaggaaagcataggagtgactcttgatgaccttgggttagacaaataaaaatggcaacaaatttaaatagatatatctctgaagaagatatacaaatggctaataggcacattaaaaaggtgctcaaaattgttagttattagggaaataaaaaccaaaaaccacaatgagttatcacttcacactcactcaatggctataataaaaaagacagacaataacgtattgatgagaatgggaagaaattgaaaccctctattattgctggtaggaatataaaatggaacagtaatttcaggaaacaatttggcattcctcaaaaagtaaacacagacttaccataagactcaagaattctactcctaggtagaattctacccaagaaaaaattgaaaacatacgtcttcgtaaaaacttgtaccacaaatgttcatagcagcattattcataatagccaaaaagtgtaaacaacccaaatgcttatcaacaaaggaatggataaacaaaatatattttcttcatgcaatgaaataccattcagtcataaaaaggaatgaaatactgatacatgctacagcgtggatgaaccttgaatacattatgcaaaattaaagaagccaggcacaagaggctacatattgtatgataacatttacacgaattgtctagaatgggcaaatctatagagacaaaatagattaggggttgttaggtgctgggggaaggagataatgagaattaactactaaaaggtaccgggatctttttgggtaataaaaatattctggtattaggtagtggttcatgcctgcacacatttatgaatatattagagactactaaattatggttatatatttttttaaaaataaaaaataaactaaaatcaaaagaatacctactttatgattccttttatataaactatgatagtaagcataaaaacaatcggtgatgatagaaatcagaaaaatggctcccgctgggggttactgaccttgggaagcatgaggtaccttctggggtgttggaaatgatctcttcctttttctgaatactggtaaagatatatacctgtgtatgtcactatttatatctgagatatatatgtaaaactattttatatatgtcattgtgttacacacttaagatgtacatactttactatatgtataacaaaatattttaaacaatttaaagctttcatgttaacgataaatattacatttatttgtaagagtcacatttgtaggtcttagaaaaagtaaaagtacaaaaagtacaagtggatacaaaagtcaaattttattatgtgattcataatttattttgcaaagagacagtttcatctctgacacacagtggatgcttaattcaaggcaatctccttctctccttcttcccttttctccttttatatttatttattcttatgctgagaatgctttgataatgcaggcctgtttgcattacaaatgatttccctttccatctctaaattctccttacaaatggcaaaaaaaatcatcgaattgataatatcactacccgtttattatttaaagaaatgaaaagtgaatagaaaagatagtactggtaacagcacaaaaaataacctcataaataatgaaatatactggtctctgcatattgaacatctggagagtacaaactgtttctgcttatcacaataattacttattaaatattacatttataaaatgaacaatatgcttgccaattactacaaatataactaatctttgcaggactaaaatagcctttgtttataatgacaaaatttctatgcttaattaggttttaattatcattaggcattttttaaattaacatttggcttcagtttctcaatgactcagctctgagactattaatattgattaattttgattgaaatgttccaagaaacctcttcttaatagatgtgatcacagagaggagctcttttgttttttctattttttaagttttggcatgactgaaaagatcattatatgtctgtattttgcttaaggataatttcaacacatatcacaaagaaaaataaaaatcaaacccccaaaatatataaaatttctatatagtctttgtaatttaaaacaatatgattctagaaattgtgttctatgataatttatttgtagacaacaaacataagtattctactgacaaaaaattgtcacactatgatattgcagatacacatatgtactaatttaattcacagtcagtggtagttttaatgtgtccgcttgactgggctggacaatactcagacagctgccgatacattatttctgggcatgtctgtgaaggtgtttccagagagattagcatttgaattggtgaactgagtaaagcaaatggctctccccagtgtgactggacatcacctaatccattgaggacccaaacagaacaaaaagactgaggaagggccagctctctgtgttttagctggactatccaccttctcctgacctcaaacccaggtgctctttgtccatggacctttgggcttagaatggaactgggcctccagtttgcagatgacagatcctgggacttctcagcctctatactttcatgagtcaagtcctcataataaatctctttctatatatctgtacacaacccgccctcccatccatgggttctgtatctgcagattcagccaactgaagatcaaaaattttcaaaaaaataaaaaataacaatatatcaatacaaaataacacaaaacaataaagtataacattgttacacagcaggtacattgtattagttattataagtaatctagagatgatttaaagaatataggaggatatgtgtaggttatatgcaaataccacatcattttatataaaggacttaagcatcccaggatttggggatccacagggcagtcctggaaccaatcccttgcagataccaagaaacaagtatatatcctactggttccgtttctctggagacccaatacacacttttttgtttaaatgtatcaaatatgagaatttttagtagcaaaaaaattttcctttttttttctttatttcttctacaaaaaaataaaaaacagaatccacctgcagagagtgcaggtttgttacataggtacacgtgtgccatgtggtttgctgcacctattgacctgtcctctgagttccctcccctaacctccccgccccccccacaggccctggtgtgtgatgttcccctctctgtgtccatgtgttctcaatgttcaaaactcccacttatgagtgagaacatgcagtgtttgattttctgttcctgtcttagtttgtgaggatgatggcttccagcttcatcctcagcaaaaagtgttttctagtcaaatctttaacaagacttcagaaagcacttacgtttatacaattgaatagccaaacttagaattgacttatagcaatttttaaaaaatagaattatactgttatggtttaaaatagcagataaccaaaataaaaaaaatcttttcaaattttactttgaggaatgttgggttttatatacatattaccttttccttgcccacctgtataaatgttagaggaaagaaaggatgctgaatttatgtatattaatgtaatgatatcattatagatgttatagagtatatttttaacgtataattaaataataggcaaaggtgggaaattgtaactagtcatacctaaatgtaggaaactataagcttcttgcctttctgagacaatgtctactgggagcctataatttcagaatcaatttcctccttctttccctccctccctccgtccctccgtccctccctccctccctccaaccctctctctctccttcctgcccttccttccatcctgccttttgtccattctttccttttttcttcatttattttctttctctcatcaccttcacctcctccattacattttgtaattgttgatatgtttggtcatgtgctggatctaagttataggtttagataatcccaaacactcattaaattattcccaacttgatttttttaatagataaaaacaaagtcattttactacgcataaaacagacattaaacctgcaattatggccgggtgtggtggctcagagctgtaatcccagcactttgggaggccaaggcgggtgaatcaggaggtcaggggtttgagaccagcctggccaacgtggtgaaaccatatctctactgaaaatacaaaaattagcggggtgtggtggtgtgcacctgtaatcccagctacttgggaggctgagccaggagaatcgcttgaacctggaggcggagtttacagtgagcctatactactccattgcactccagcctgggtgacagagcaagactccatctccgaacgaacaaacaaaccctgcaaatatttcttgagtactcactctattttcttattccagtggccagtagaaaaatcagttaatgctagtgaaagtcttttgagattcatgtgtgaaatatgtaatcttaaattgttggccataatttcataatttgccaattatgaaaatattctgaactgtagtctttttttttgagtgaaaatacaaaattaaaaagagattaggtagttaggtttaggtaatattatcaatgtagaccaatgaattaaattctacaggaagaaaaaaaagaactcatttggctactttatagttaccaggagccatttcccatcctgctcccaaactgagggcacatagatttaaacaaatttctgctttctcaggaattacaacactttagaaccacaagtttatttacttatttaaggacatatctgagtcaggacttagtcacattactaaaattgatttattaacttttttccccaatgattgaaataattttaaatcaaagtgatctgtgttaaaagtagggagctttttctgcatgaagaaataacaagaccttgtaggtcttattaagcccatattaagccattgtaagcgttttccttggctttgcatgtaaaatgctatgtggtctacaaaaaaagtagcaagggattccttaagttttctacttgttaagtggtccagttcatagttactatggatccagttcaaagcagtgctctgaatactaataacaaaactagttttgctcaagtattttttctaattctgaggttaaaattgaaaacaagagctatattcaatattaaattttctcgtttacaaaacaatgtatttatcctggagtatttttcttgtttctacaacttcagggaaatgacaagctgggatttcagaagttctgaggatatattttgatattttaataggactattgccagctatgattagacactcaataaataattgaattgaattgtttgggtactttcatcaaagagaacataatgtagatttctttttgtttttactttagaatactcctggaaagtcttcattaagtagaaaacaaaacaaaccataagacccacaaggaataacaaaatcgacttaggggctatggagtttgacttagcaacttgtactcgatcctttataacaaaacctctctgctaatgtgaagcagctgtggcaatttcacaaaatggcctaaactgttgaaaagccattaagggtctgatgtatgtagaataaaaaggttcattcagctttttaaaaggtttcccaatatggagtgttattttattttataaccaagtcttagtcatattaagtttaaatgccacagaaaattttaatgaccatgtggctggctttttcggtgaaatagcaggaattcttcaacatacctaaaattcttttagaaaaaaattggtacaaatctataagacacaccatgcaagttcccactattaaatgcagaattagaaaatttagcaacacatacagggtgacttaccatttatgcttgtcggggcacctaactgaattggaatcaatttctttaatcctaaagcacatagagtctgctggaaataatgaaagccacttgctttcccagctttttcatagatctgagcctcaattattaactgtatatttttgaagttagtttttatagatcgtatgatttaaaaaaacatgactgtgtcttttcctaaggatgtgtgaaggattacacctccaattctcattcccttttttcctctgaaggtggtagctatatgatgctttttatgcattcacctgctttacttgttattttgaggtttagaaggtctatctttgtgcccttcaaattatttctaagacagcagaagtgttagcttattaacgtagtctgtattctacctgcaatgaggtagatatatgatttccagcagacttctaattgtacagccacaagagctgtaaatatgttccttagaaatgtcttgtgaattttcttgtacttttcctgatatgtgcatcaatctatgtgctattcagatgtactcagctagactggagggatcatgtccagaggactcctgtgagtgttgaggcccacacaccagagaaaggccagtttcaacctgctgtacgtcatcactctgccatgttaacctgaaaagcagtgtgatattgtgatttgtcataggaaatatgtattcggtcttcatccccattcctagcacagagttcctagaactcttataatttcatgagtaatgggagtggtgggggtatttttttgttataaaatttggccttttgccttcaactcctgcaaagctctagagcaataaaagtgaaaggagtgcgttttgttattcataacaagtccatttcaaccacaactgagattatgtgaataaggtgatttcagaaacccccatcacttgatggggagatgattgacaaggggaccaaccctgtggttagaacttggggaaaagagaggggctgcagactgagctagttactactggccagtaatttcatcagccatgcctagataatgaagcctatgtcaaaccccccagaaacggggtttggagagcttctgggttgctaaacatgcagaggctctgggaggacggcgcatctggagagatcatggaagctccacatcctctttcatgtaccttactctacacatctttctagctggctgtttccaagttgtatcctttttttaacaaaccagtaatttagtaaacaaactcttttcctggttctgtgggccattcaagcaaatgatcaaaccctaggaagaggccgtgggagcgtctgatgtatcgccactcagtcagaagcacaggtgttaacctgcacttgcgattggcatctgaagttgggcagtcttgtggggctagcctgtaacctgtgggatcagatgctaaccttaagtatatagggtcagaattgaatttaattatgggatagccaattggtgtctgccagagaaccgagctgaattattgtggaaaccctcctcacacatccagagatctgaaatgttgtgtgagagtagagtgagtaaagaaaaacagtttgtttttcctaatcaacaggtcgcaatagaaactttgatgcatagggaataggactggccatcttctgtgaaaataagtaagtccaagaaatgggagcctaggatttggtcaagtgggaaggaacatttggagatgttgattctctgaggattcaatcagcatgtatttgtgcaaggcattttgctaaatgttttgagacagagagctgacacaagatggtccctgacttcacatggcttaggtcttgttggaaagatcagatgtatgcattttttatgttaatagtaaggcagtgctgctctatgcagagtggtgttctcctggcacatgacactggtatcggtgtgtgagatcagggaaagtgcctgtggacagtgatgattctcagcacaccttgctggacagattggctttgtgtaagactttgaatcaaagactgagacagggcaaggggctcaaacaggtgcccccagcccgtacctggtgcaccgaactttccccaagtacataatagcatcccactgaaagaggacagggcagtaggatggagatcaaccccacgccgtttggaaagctaaggattgagccatagggcacagagaggtctcagtgtctcactggtacttagatgccaattcctgttgaagagatggcacagtgagggggaatggatgggaaatattttaagactgaatagtggataaggatgacaagggctaggaagttccagagagggaacagtgaatggaagacttggagaagtcagtggaagtccgattttacctgcaacattccagcctcttaataaatagccattgactaacaataagaacaaaccagatgtgctacaaaaccatagtttttcaaaacttaccagagtgctgaagataaaatgaaacagaaataaactaaattctagaaagtcatagacctttccaagagagatgcgacccagttgtttttatccctgggggcattataaatacagagccgatatgccacagattggggtaagtggaaaccagctccatttttaatgaactcttaatagccacccgtgggctggtgtggtagatgagatcgccaaggagcatcctcctacagtgagtctacacccacctgccatctctttcccccaggacttttactgagagcacacaactaaagagccaaagactgacacagggcaaaaggctcaaacaggtgcccccagaccacacctggtgcaccatactttccctgagtacataatagcatcccaatgaaagaggacagggcggcaggatgcaacctcatgccatttggaaagctaaggattgggctataagacacagagaggtcttaatgtgtcactggtgcttagatctcaagtcctatggaaaagatgaaaccagtggtaaactggagctaactaaagctgcaacaaagcccagaaccatctcaactatggattggattgactgtcacttcccaccctacaccctgcaccatcccagagtagaggactgacagagaaagggatgctccctttcctggaggtaaagatcatttatttacttgtctcctttttttattttatgcataatgtccagcaaacaataaaatattacaagacacctgaagagtcaggaaaatatgatgcgtaatcaaaagaacaaatagccaacaaaactaatccatagatagccagatgttggtatcagcagacaaggactttaaaacagctgtaatagcagctgaaatgaaacaatctgatgaaaaaggtatacaatatgacacaatataatgatctacagttagtatctaagagaagcagaaaaggtccatctatccctctccagtgatctgctttgaatttatgatttatttgctaggaagtaagaaataattaaaattactttggtgaaaaaatggagacttggagaatttgaaataaacttgcgtatggctattaaggttgagacaagatgctgggactgtttaattctaatgtctgactttgccatatttttaactattttgaaaattttcattctatcatattctccttctttatgtattttattattattattttaaaagtcaagcaatattaagaagaaatccaaattaggcttacaaagtgaagtagatgccagtcacgagttttgtccccatgtgcaatcttgtgatctgagattagcaatatcatctgtatctattaatcataattttatacataattttaattatttgacttgatataatactttcaaagtcatctatggttcatgttgttttcaacaaacatttctattcagtaattatttggttctatctttgcttactgatatagtattaaaagttatattttatcagacctaaaaattatatttttaaaaatacaaaatgatcactgaataaagagggtttgtaccacagtgtttttgcttgctacagtgctataagtttcatttattccagattattttacacaaaatcacacaataaaaaaggaatattttataattctatgtattccacagtatccaatattaactgggtagaggataagcagcacaattacagtaataaatttaaccattcagttattcacattcttatttcttgctgctgctgaaaattacaaatatgaataagaccacactgcccttaagttgttcatggtctactaattgattgacattagtgacaggtagaatatagagacagaaccatttttgatagtgttgtggcatttgtcttcttaaggtaaagtataacttaaaaaaaaatagattgaataaagcaatacatgcgaagtagtttcaaatagtgattggcacatagtaagtctgcaataattgttagttatcttattatttttattaatatcattattataaaaacaaagtaaggtaaagcataactttaaaaaattagattgaataaagtaatacatgtgaagtagtttagcatagcgattggcatgtagtaatcctatgataattgttagttatcttatttttattaatatcattattataaaagcaaagtatagagatgatctgaaggttttcctcttgtatgtataggtacactaccatttgcttcactccctaaaatgttacatttgaaaagtatagggaaaacatttgaagtaatttgaattttttttttttcagaattaacttgcaaagcctgaaacaactaatatggataagttaagcaatagcttcacagcaggaaattttattttggtagccacagactagttttcactatatttcaaaagcattagaacttactttgcgtttttgtactagagtgttcatatctagtttggtcagctttgccatttccataatcagttatacatgtaaaacagatatacatgtctgggtaatagagcttacacaattttgaagtgtctccttaagaaaaagggcttggaaagaacctattcaagtgaggggctctgaagcttaagcttcattagattcatgataaattgtattctgctttgttggtatttaaaactgttctccaagatgagatcaatctaaatttggtttgctgtacaagaatgtacgctcttttccgtgccactctcttgctttctctttaatcacttcttcttattaggcattagaaatacagcctctattggttataaatatgttaagtcctttgggaacaaaagtacaatgaaataaatagaaaataacatacattaaatttctttgggcatagttgtaatttctgtgggtctacatttaggtctaccagatttcctttcagcttaccttcttttaaaaaattctgttaatagagtcatttgcctgttttcttagctgcctcttaagaaagccttaagaaaattttgtgatttttttaaattccacaaaaatacattgaacaactactaaataccatgcaccatatcttcccaagtcagtaatttacctacactcccttctgttctgccttcacagtaccttatattgtgtttcccatctttcattctctttcctgcccccttctgtttgtttttaatatgatcctctatggactcctggtcgtgtcagctttcctactatgatacactagtttctaggtgataatttgaccactgtattcttaaacatcgaaggatagctttaattgatttaaccacttgactttaagctgcagttcaatgttcaactgatatgatggcaccattcataagggaagaacgtatgagacacataagtcaaatgggagataggataagtgctcctatctgacatcttgattaatatgaattatgtcaagcttatttagtagttcataagttcacatcagcaatgataacagtagccattagtgatgaccctgaaaacgttgagcctttaagagctaggattttctttgaagttcaggacatttagccaccaaagttcaactctaagacaggatgcaaagtagaaagtggaatctgttgaaaacatcaatggacctaatttcctttttcaccatcatgcttcataaagttctcaggtcattttcattagttatggaattatgatacaataaggatattaataaaatcaccaattttattttcaaagaagagatcttagtccattttgagaaaatagatctctgtagggcagagggaaaggggatcattcatttttcctagaacagggtatacgacaatttccacacagctgccttgctcagttttccaatgatcatggaaggaccctatagaggaatagtagactatagtcatcaggctgtaacatgtccaagacatagctgtcttttcattagtcggtagtgtttctcatggagcactcttggatcatctgtatcaggatcacctgggataattattaaaaatggacattcttggaccctaccccagatctactgtaccagaatctctggagatggggcttggaattctgcatttaacactgtctctccagctacttgttatatacactgaagtctgataatcagtgccttctgagtgcatagtttttaaatcctgaaggatttatgaaatttactttcttattcatatgtacttagtgaaaaactagaatttttatttttgaacaaaggagatattaatgaaggtaaaccttggtggacccatcccttccaatgaaatgcttagcatgcctatggtgaaattaaatcacaaggaaaaagagttatataattactccttttccccaaaaaaattcagttaattatgagatctcgaggatggcttgtagcataacataattgaggtcacttgaaatggcattctcaactctgatactccacaatggtcaccaagagcagatttggtggcaaattgcacacccagaagtatacctggaatatcataaacttcttggatagatggtagtggttacatgtgtcctggtgtactaattatttgactatgccaatccagtgtaaaatgtgtccagacagaaatgtaactggatgcctggtgatatggtttggctgtgtccccacccaaatatcatcttgaattgtggcacccataattctcacgtgttgtgggagggactcagtaggagataattaagtcatgagggtggttcccccatactgttcatgttgtagtgaataagtctcaagagatctgatggtattataaacaggagttcctttgcacaagctctctctttgccggctgccatgtaagatgtctctttgcatttccttcgtcttctgccatgattgtgaggcctactcagcgatgtggaactatgagtcagttaaacctctttcctttgtaaattacacagtctcaggtatgtctttattagcagcattagaacagactaacacacctgggcataacttagtcaagagatgctctacattattgacacagttgcaaagtggctgaatacggagtttagtaatttcagcttgagggaatgccccatttttgtaatctccattgaaactcctcatgattgcacttaggcattccatgtgtttgcagatctatttttgtctcttgtaatcttcatgttaactctcttgtgctactctcacctcagggactggagtttgattccagcctcagactgttcattaatccagttgctttcttacagttcttgtcgcattgttcctgcagaggcaggaaagatccccacggtgtggtgtttacagcgtatgtgattcctgttcctgtctcagaacctgttgtctggcttggggtctttcctttgttgaggcctgaggcgcaggctcagattaggtgttactcctatctctttatctccggaaatattggagatggtgaatattcatattgaaatctggaaagtgttttaagttctttacaaaagaacttaaaagtcaatgttaatacaaaaagtagaaaatctcaaaaacaaagaaaccctatctgatatcatttggctctgtgtccctacccaaatctcacctcgaattgtaataatccccacatgtcagaagtggaaccaggttgaggaaattgaatcatggggacagttttccccatgctgttattatgatagtgagtgagttctcatgagatctgatggttttataagcgtctggtatttcccctgctggcactcattttctcacctgccaccattgaaaaggtgacctctgccatgattgtaagtttcctgaggccccgcagccatgcagaactgtgagtcaataaacctcttttctttataaatcactcagtctctggcatttcttttagcagcatgaaaatgtactaatacactattgttaatatttaaaaatgataagagaaaatgcatttatgaaatcataatgagaaaaaggatacatttatattacaagaacagagctcttgaaaattaaaaattatgataaatgaaagaaaaattcaataaaaaataagaatgtacagttgaagcaatattctagaaatttgtatagaaagataaggaaataaaatatagaaaagatagaaaggtaggaaagaatccagaaggtgaaaaatttggacaaaagaaattctagaaagacagaacagaataaggaagggagaaaattattaaagaaataatttaaaaatgttccagcactgaagggtactagcattgaattaaaggagcccaacaattgcctagaacactgtatgaagaaagatctgtgctacagcgtgtaaaatttcagaccatctgaggaaggagaaacttctaaatgctgattagaggaggtcaggagaggggcggggagagagagagaaacaggaatcatgtatcaaaatgacagatgacttctcaacagccaccctggaagaaggggaacagtgaggcaaaggcttcaaaattctcaaatgttatttcaacctagaatctgtgcgtattagaaatattctcccaaactaggagtcaagtatgagagaacagaaaagagtttcagacatgaaagcttcaaaatgaacctattatataaccttgcttagagagcctctgaaaaatctaacaaaacccagaaacaggatgccttggtatccagaaaatagggaaatcaacatagaaatatagaagaaaagccacagaatgaatgaggaaatgtggctctacaacaatagctgtgcggatgatctagaaggcaagtagtctagattcaagcaggctagatagcttcaggtaggctgtcttcaagaggacaaaatacataaatacccaatgtgttttaacctcttgaagcaatatgtagtgttttaggctcttcttgtgttgctataaagaagtaccgaaggctgagtaatttataaacaaagagggttaattggttcatggttctgcaagctgcacaagcataacgcctgcatctgctcagcttctggggaggcctcaaggagcttttactcatggcagaaggtgaagcaggagcacgcaggtcacagagcaagagcagggcaagaaagagcaagggggaagatgccacacatgtttaaagagaactcattcactattgtgaagacagcacctaagggcatggtgcttaaccattcatgagaaatctgcccccatgattcagttacctccctctaggccccacctccaacactgggaattacatcttgacatgagatttggaggggacacccaaactgtatcatttatgattatgggaaactaagaggagcaaaattaaggtgattattaactgaaggaaataatgaaagttgtacaagaaaaacaatcatgttaaactacatggctcagctcatgaataacattcatacataaaaagtaacatgaagagtggatacagatgtaactgagaatgaagacatagctaaggcagaaagatgagacactgaaggcaggtgtgcacatataagtggggaagctgggagggctatcaatcagatgaaactttctttatttccacaataggaagttagtaggtatctaagattcaaaaatcaagaaatgaattataagcatgctagttaggaatatgaaatgaagatcaaaataaaaggatgggcaggttgaagttttttgtctctggggagcagaaatgggattgtggtagggaagtggtagggcaaggctagttttcatgtagacttaaggaaacttttgaccttctatactataaatatgtacaacttgaataaaaataaaaattctatacatgttacatagaactccttcttcaacatagccccttctctcacccttcctactgatgagcaggtttagattggggataatgcacttctctttctaaccagttactctgttaacctgaaaatctagcaaaaggcaccagttttttactgatgtcagtttctttcaaatcagtgttttttaaaacagtgttaaaacattttcatttaaacttttcatggctaagaacaacatattatacctctactttctttggacactatacattgaaatattttatagtttttattaataccttattttccctttttatttgtgaaactcttcaaaggctacaaatggaatgggacttactgttaatatgacttatcatggtcattaaattgagttaatttaacactgttccaaagcaaagtaatgtgttttagttttaaagatgacttataaacatattttgctaatttaagagaggaagatttccaacaaacaaatacaagaatatgaaaatgtcagctagcaggtgttttgcaggaattgctgggtggtctggaaacagtggtcccattagattgggatggccaattaatacgctttaaggaggttacttttaggctgaaccaaaaggaaaaggaagagacagtcagctgaggtttagagaaagaagttccagacagaggggtctgtgaatgcaaatatcctacaggaggaacaaacttgcctccaatttggggacagcagaaggtcagtgcaattggagtcaaaccaacaaggggaatgaggcatgagataaagttagtggtgtaggcaggagccagatcatgaggtgctgggtaaatcatctgcatttactttttaaagacgatgggaaagccatcaaagagtttaacaatttaggtgatgcagttttggcaggagtaccttataccttggtataagaagtttttttttcctcttcccttctcattttcttttctctaactttttcttcgtatgttaatactatagaagtcttatagaaataaagtcaaaatactaataatatagccactatctgctttaatgacaactttctctcgtcatcaccctttaaactattcttggttttactccccaggcaccctcttatctattaagtgaattccttttgatccttggaaactcatcttggtgtcactttggttaagctttccctggtctttttaaacataattaaggcattttatacatggactcgtcatagcagttacgacattgtattattaatgcagttctattcactttttcttaactgatcatgagatcctcctatcctaaataacatgagtttgacttgataaggatatatgctttttccttaggtctcatgaatataacacgatgcccagcacatagaaagcatacaataagtgtttgttggataactgtggacagttcagtcgaccagcaagtgagtagcaatgtggggagtagaatcgaagtcttgatctacagatagaccagaagtactgggtccccttggttattgaaaaactgtcatctctatctatggacatcacacatgtgccgctttatgaggatcaatatcatagcttcataactgatgaacaaatagattacaggtggggaaagggagagatctctgctagctcccaggttgtccctggtagcctgaggtagcctggtctttaccccagtgtgtcatacatatattgtcattttccatgtaagccataggatggaaaacagttgacaacactgtatataacctgaagggggcatactgaacgatgatcaaaatagtgggttgattgcaagaatgagttgacaaaattttacaatctccacttagctaaaaagaatagtgcatgtatgagtaatagatatttctgcttgttagggcctatatacaggatcataattttcccttgggaaaatttctagaacagctttgtcttaaagtaaaagttgatttagagtcattgaaaattattcaaaatgttaattccagtttttttaaaaaagttgttacagttatttctgatttatgatgaacaggctaaggaagaaatctgttaagctttgagaattttgctctgattacacgaaagcaggaaaaacagcaaaattaacttttccttgctcaggggtgagttcattttgtcaaagttaatattcatgatagttcagattggcctcaactcaagcagggccagcagggttattttccatttggcagacttatctgtaaatgggcaaattccacatgtagacaattatttctggaaatataagtgtgtgtgcatgtgtatatgtgtgtgtgcatatgtgtgtgtgtgtacttattgagaattctcattaattcatgccaaatctgtgaaaaggagtctacattaatttaaaaaaatcacaaagtactttgttactaaaggaacatgtaataattaatgactacacgtggctgcggtataccctttttttgtaaggtttcttcctgagacttttgtttctctaaccaagtgacaagatctaccaaggtttaccttggtagaccttttctttggtaaagtaagggtaaactttaccaaagtgcctgttgaaatttttctacagatattaatatactaaaaatatatttttaggtgaggtattttctttcttgggtcaattctggaataatccagaatttaatcaattagctcaaggatacgaaatgagtgcaacatgataggaacattgtttttaatttcaagcatataattttatgggtgaaaaactgaaaacatttaacaaagtcttttttttaatccaaagatgcctttctcagtcactcaatacttctgatatgacattaatcttgcttttcctaaattacattttcagaatcacattttcttttaatataattcaaaatatttaatattgttatggatgtagtttctctataactcctaattcaaaatgagaaaataaatttgtgagttatgatcttgatgtattttatattttttaaaaagacaactcaattagatgaataaggcttattaagtttatatctcatgatatttattcttaagagaagagttctaaacaaggacgataacatgattcttttcatgaagagttttctttaaaggggacttttgtggggaaaaaatcacacacttccttgtgttacacagcaagcatcctgtgtgttatttagagatcctttatcatggagggtggtccagtggtaatttaccagggaaaaaaaggagtgtacaaaaatttaattattatttgacctcaaataattatatgccactaaactaattaaagagcaaattaacaatgtgccactgatgggcagtctgctgtttgcatgactcactcatcttttgcaaagaataagtgatttgtattagaaatgagttgttaaggatgttttgggggataactatcgctgtcatttctatgttaaatcacaggcccaacctctggataaaaagagacaggcttatcatgagccagggaaacggcagccctagcctgatagctctgactcgaggccttgtttaaaagctatgactcagtgcagggcagccagggagctctggtcctctcaattccttccaaaccagccattcagcctctaatgttcaggttgcgtgcctcatgctgattatttctgtgaagtccatcagagtcagccttattctcccaagcattcatcttcatttccaagtgaatgaagggggatttcagtggtactactgttcacagagcagagctaatagttcaatcaaacaaaacaaaacaaaacaaaaacaaaaaaatcagctaaagaaactggtagaagaatgttagttctaacatagaggctttaaatacatcaatgtggagtgaaagggtgtttgtagtgagtgtgctcctgtagcttgtgcagtttatttttatgaggattaaaatatccgtaagtatgaacagcgatcccctatttacatgtattattattgagcggattttttattttcattctgtctctttttataacttcacatatgacttcttttattcatttcatcccttcccgtaaataaactacaaagacttattttttattacttctttattcaacaacctatagtttaagataattggttgatcaagaggcaacaacctagagccccagtataagtcacattatatttccatcagcaacagcacaaatgtgataataaattgctgttgctggtgcacagacacaacaggtattgtggcttgctggaaaaactatatccctggtggcaatcttggaatgtaaacccagggacagtctattactaccatgcttagaaggaagctaagttggaaatccagatttttatgtgaattcaatcaacttttaaaggttggcaactaatttaaaattttcaacactgtgcagaccagcaaccaatttgcaaactatctctggcccatgggctgccaaaatctgaaccctctgatttaaattctgaagttttaatgacatttcactttaatttactgagaaatgatcctcattttctattacttcccctcaatagaaacgttgcaataaacaatagaaaggttgggccaaatataacaaccacaagtttttacaaataatttgatataaatcaattatagttaccattttataaattggaaaagagatgcttagagtaattacatgatttgcccattagcatgaagctggtagtgtgcatcccctctaaatattaatatcagtcttgttttcttttcagtcaacctactctgtggactgaattgtgtctccccgtctccgaattcatatgttgaagccctaaccctcaatgtgatagtatttagagacaggacctttaaagagggaattaaggttaaatgaagtcttaagtgtggggctctaatttggtaggactggtatccataagaagaaaaagagacaccaggggactttgcacatagaagaggccacagagctctctctgtggccatttgcaaaccaaggaatggggcctcaggaattactagccctgctcacaacttgatcttggactttcagcttccccaactgtgagaaaataaaagtttgtcgtttaagccaaaatggggcaaacaaccacagcctcctccactcaaaagatcagatactgattacgtcatgtttcccataagccagtaacattccaatcatccataatatcaagttcaaaatatttcgatgtaaagaaaccaattatatggacatttaaatgtctgctcttatatagcatatgctaggacataaatacatttattgaatgaatggttggtactaaatactgtaatgtttgaaaatctcagtgtgattaaaatatttccttttactgtttaatgacaaacattgaatggatgtagacataaatgttaaaatttttcaaaaagatataacaaaaatgcaatctttttcttaaaaatgataatttaacacaaacttttatttaaaatatgagaagaaatgttgctatttagactttgtactatatttaatttcacccaaagattatactttttccatacctgttttctaattatataatttaaacttagttgtgaaaatggcattttaaaagagctaaaacaaaatctagaacattgcattataagaataaaaagataattaaatatagacaccaaaaaagtcctatcagcatgactatacagtattaaaagtaatcaaaatattactttattataaattatatgaaaaagtaagtagctaacatgctcttgagcatgcaatgcagaaaacacaatatgttatttggaataaatcacaagaagacgttgttattttgattagaaattgaattttaataatgaaaattttcaatttctttcagagtaagaaaagtgagtaatacaaatgaaaaattgtcccatttggaaaaacttttaaggtacagacctggatgaagggattatattactatctaatgtcagaaaaaaatgaagattaagaaatgaaaatgtgtcctaacgaagtagtatttaagagaaatgaactatttgcaaatatataaataatcagttatttagaacagtaaagatgtttttgttacccccaaattaaaattcctatgaaattaaattttataataataaaaagagacatttattctcatgatatacaaatataggctatgcttactctatgtatataagtgacagggaaactggaaagagttagaggggagaaaggaggaaaatgcctcaatttataacagatgtttaaaatgcaccttgggatacattcattacggacatacacaattaatccttcagaacctgctgctcacatcatgctttccttacctgttcaatggtttacacctgcacattaggagtgcacctggttgaaatgtgagcgactcccaacaccagcttgttaaatcttttcctataaattctcctctttaaaatgtagcaaaataaattcagaaacaaagaaacgcacctacataaacaagtagatccctgaaaagcataagcagccactgaactcaaccaaaaagcacaggtggaaggagagtttaaaggaccttagagcactgtgaatgtttttcacagcgtcacaattacagaaacacctggttctgcaaacgggctgatccactgggaaaattttccagtgttcaatgggcctcagagtggctttaagacatcgaatgggggctccatggtgacattgaattaaaaatatctgggatcccaggctaaagaccttcttggtaactgttgttctatccaccaagtaagtctttactatgcatttttagtgcacttattagtagcaaaactcaaaacattatgaaacttgcctgaactttggagaacatattgaaattaatatcaaccatttattatatgatgtgagatctaagaaatcattaggcaaaataattagccaaactgctgtctggatagagagttgttatttctctctctgtgtgagctacaaggcttagagtaacgactataaagttgtgagaaagcagtgtggtggaaatcagatgtcacagattaccctggtgacatgtcagttggttcctgatcatctttatttcagtatataactttaaatgcataacataaatatttgttatgctttattacatcttgcataattataataattaagtcataactataatcactaaaaatgtatctttctgcttattgttaattctatatgcagtgtttcatttggtagtagagtgagaagatgagaaattactaaaacctaaacaatgtttccatgcatggcatgtatataataaagacatataattgatatttttaaagtttcactcttagttccatgctttgcatcagttgagacgtgatgtaatcttatcctagcaagtacagaaattctatttaatgctctaccttctgactaaagtcttcacggtatggatgcaatattcagttttgaatattgctacttctcagactgacctccaggcatttgttcatatgttaatacaaaaccacaagtacaactctcaatataaaaataaataattctggattgctctctgcagctgtcctctttgttgatatgaaaaataaggaattgagtaaatatcttcccactgctattttaagaaaacgagagaaaacaggtacctactcacagagtaatatggcctcacacatagcaagttatatatttgaagtggagtggggttttctctggaaagtcttcaaagtgctggattgcaactggcaggtttttggatataatataaaaggagtaataggggatacagttagggtcttccaagttcttcagctcttactctgcttgagatggggagacactggatattgtggcagtggaaggacatgagtggttttaggttttagcagtactgatcactgatcactgtaccagttcctgattacagtttagagaaaagggagaaagagcagaagcagggagaccagctaggaggctactgccctaatccaggagggatcaaagtggcttggattagggtggtagcagaggaaatggtaagaagtggtcagacccactctgttttgaaggaatatcagatttgggataacagataagatgtggaatcagaaagaaaaagaggagtcaaggatgaatccaaatttcgtagcctgtaaaactgaaagggtaaaattgatttaaactgatatgagtctaggccataaaataatatttgggaacattatttttattaattgtgtcctaattttacaatggcttgactctggagctttaggatgatgtctgtctctctgctatcacgaataaagctgtggctaatatccttggatacaaatacttgagaacatttctgttatttctctatgatatattcctttgatcaggtcaaagggcatgaattttaaggcccttgatgtgtattgccaaacagcttttcagaaactttgcaaatacagtcggtatgctaaagtaaagatatacaacatatttttttacttaactttttatgataaaaatacataattaatttaacatttagtaatacagttatgatgctaagcatttttcatacatcatatttcatcgtcacggtatcatatggtgtagatattcttatcgtattttacacatgaggaaacaatgtcagagaaagcaaactgtccaaaatcatatagttggtagtgtcaattcaaataactgtctaactgcaaaggcttggactgtgaattactttgacacattgcttccttatcttaaaacttctgtgtgcttgtcttttggtgtatttcttattagatatctttagctggctttttgaaactctagttgaagtctatattttaagtgggatgtttagcccattaatatttactataatagatatttaattttacctttgttccttaaattattgtacatgtagtttttttggtcttatatgcctccttggatccattttatttgcatttgtttattccaaagctttgagtagtatatattctactttgaattttgttaatgaatgacaatttttaaagacatatttcaatttatattaatattttcctaatccttaattccgtaactttcactcatttaactcttgaaatacgtttatgaaacttaagaaattaatgtagattgtatctttcaaaaatggccgtaacaatatctcctgtcccacttattcttttagaacaggagtcagcagacgttttctgtaaaacaaaacaaaaaaaacaacgctagtaaatatttaagctttgtgggccacgtggtgcctatggcaactactcaactttgctgctgcaatacaaaagtggctatagacaatacataaatgtatgagtgaagactgtttgtattccaataactcttcattacaataccagctagcaggctaagtttggcccataggctctagtttcctgacccctatttgagaatgtttacactcctccatcaagaggtggaagctgattctcttcttcccatatctgggaggatctctgtctcatttgtaaccaatggaatgtggaagatgtggtgttgcatgacctaaaagctacgtcagaaaagacaatgaaacttttgccttgcttctagactgttagaatcctgagccaccaatgtaagcagttccaatgccctgaggctacaatgacatgaagaagctcaaactagcacccccaccaccaaaacaatagaccaaagaagaagccctgagattacataaagagatgcacaagctccgtccaaacttgtctctctaatgaaaaaatctgattgggaaccacacagataagcccttgccaaatcttgacccacagaacccatgagagagaatacactgaatgttgctgttttagatcacagagttttggagtggtttgttatgtaacaacagtaactgggtgatatggtttttctgtgtccccacccaaatcttgtcttgaattcccacatgttgtgagaggggccctttgggaggtaattgaatcatggtggcaggtctttcctgtactgttctagtgatagtgaataagtgttagagagctgatggttttaaaataggaattttcttgcacaagctctctctttttgcctgctgccatctatctaaaatgtgacttgctcctccttgccttctgccatgattgtgaggcttccccagccatgtggaactgtaagttcattaaatcgctttcttttataaattgctcagtcttgggtatgtctttatcagcagcatgagaacagactaatacagtaaattggtacagggagtggggcgctactagaaagatacctgaaaatgtggaagcaactttggaactgggtaacaggcaaaggttggaacagtttggaaggctcataagaaggcaggaaagtgtgggaaagtttggaacttcctagagacttattgactggctttgcccaaaatgttgatagtggtatgaacaataaagtccagactgaggtggtctcagatggaaatgaggaattcattgggaactggaggaaacatgactcttgttatgttttagcaaagagactggtggcattttgcccctgctctagaaatttgtggaactttgaacttgagagatgatttaagatacctggcagaagaaatttctaagcagcaaaacattcaaaagctgacttgggtgttgttaaaagcattcagttttaaaagagaaacagagcataaaagttcagaaaatttgcagcctgacaatgcaatagaaaagaaaagcccattttctgaggagaaattcaagccggttgcagaaatttgtttaagtaacaaggagccaaatgctaattgccaggacaatgggggaaatgtctccagggcatttcagagatctttgtggcagcccctcccaccacaggactggaggcctatgaggaaaaaaatggtttcatgggtcagacctagggccccttgctctgtgcagcctaaggacttggtaccctgtgtcctaacccctcaagccatggctaaaaggggccaaggtacagcttgggctgtggcttcagaggttgaaagccccaagccttggcagcttccacgtggcgtagagcctgcaggtgtacagaagtcaagaactgaggttagggaacctctgtctagatttcagaggatgtttggaaatgcctggttgtctaggcagaattttgctgcaaggatggggacactcatggagtacctctactagggcagtacagaagggaaatgtggggttggagctcccacacagagtccccactggggcaccacatagtggagctgtgagaaaaggctcagtgtcctccagaccccaggatggtaagtccactgacagcttgcacaatgcacctggaaaagccgcagacactcaatgccagcctgtgaaagcagctgggagggaggctgtaccctgcaaagccacaggggtggagctgcccaaaaccatggaaatccaggtcttgcattagcgtgacctgggtgtgagacatggagtcaaaggagatcattttggagctttaagatttgactgcccccactggattttggacttgcctggagcatggatcccctttgttttggccaatttctcccatttggaatgttgtatttacccaatgtctgtgcctccattgtatctaggaagtaactaacttgcttttgattttacaggctcatgggcagaagggacttgtctcagataagactttggactcttgactttgagttaatgttgaaatgagttaaggctttaggggactattgggcaggcatgattggttttgaaatgtgaggacatgaaatttgggaggggccaagggtggaatgatatggtttggctgtggggacacaaatctcattttgaattcccacatattgtgggagggacctggtgggaagtaattgaatcatgggggcaggtctttcttgtgaagttctcatgacagtgaataagtctcatgagatctgatagttttaaaaacagcagtttccctacacaagctctctctttttgtctgctgccatccgcataagacatggccagctattccttgccttctgccataattgtgaggcctctccagccatatggaactgtaagttcattaaacctctttctttcgtaaattgcccagtctcaggtatgtctttatcagcagcatgagaacagactaatacactgggacagaattggacacctggatgtgaggtgctgctgtaacaaaaatctaaagcatgttgcattggttttggtactgggtggaagacaggagcttgatctcgaagagcattttagtaaaaattggaagggtctccagaaaagtgttagaatcctaacggccttaggagctgtcagtaaaggcatagaagaaagtgaaggaaatattattggaagctgggggaagtgagagtcctgttattgcgtgggaagtttagcaggactgttctttgcagtaacatggaaaagaggaaatcaacctaatcatctcagtgacagctaagatttccaggcagaatgttgagggtgcctgaggagaagcgagagatgaactaaagggcatattgttcagctttcgagtagaatttagaggacatataatgtaaagggtgaagaacagtctttttttttcccagcgaaatgttctcaaagaaagggcctcagaacaaagaataggtaaaatttggagtttttgttaagatctttaaaagatctaaagtggtactttataaaaccttacagacagacaaaagtacctctaaggatcctaaggcatgcctttcaaataccataccttccacaaataatacagctgctaagagtcttaaagtcttagctcaaagagattgtgcttatatgtaatagagtgacccccaatatgatttattttaaaaaaccctataaatattttaaaataattattctaaaggaaacaccagaagcttgacctaaaggaggcatttagactccacctatgaaggacaggaagaagaaatctcaggtacacatcagcccactttgtatagaaaagaaagaataattcacaaggaagagccaggaaccatggagaacaattcccagagattagaactgaggccccgtcaaagaactggcaagatatgtcctgttggattgcagattgcctcatgcacagtacattctcccccacttttagaatgggcctgtttattaatagttatacccatctcaccattgtatgctgagtgtgtagaggagggcagatgacttgtctttttagttcactggcctttagattgagaataataatatgcaacttgctgtacctgaggaacttcacctgaacagcctggagtgtacaatctgattagatgacaaggtctcctacaagcttgagtatagtgggatgagaattcgtgggttttgggtggggttgagtgaattttgtatgtgagagggatgtgattttttgtggctagaaaacagactgtgtcagattgtatattccaaagctgactgcaaaagtatctcctgcctcatgtgcccttctagaacattgcaacaatcttcctaagatatagagtctaattttccttcccctgaatccaggcaaattattgactcccttataaccaatatattatgctggaggtgacacttcatgtcttatgagggggtagatcagaaaagaaaaaacaacttccctggaaaattcatgttggagtccttaccaagtctgtaagcattttcagtgtcctggggctgctatgctgctagtccctatggagagacaacatgatttcatgtggagggtgggggtagaaggagagagacagaaagagagaaaaagagagtgcctgttcagttcccagcttctccagctctatccaccatctgacagcaaactaataaaagagatcttgtgccagaattacccagaggacccttttctgaatttctaacaggaaccatgaaagagagtaaaaaataaaataaaataaaatgattattgcgttttaagccacaatattttggagatagttttaaaatcagtgatataaagcagaatagtcgtcaaaggagggaaactagaatactgaagcttctataaattgtgtcttatgaataatgtttgaaggaatttggagtttaaatatgaagaaataaagtattggggtatgtatttggccacattgtaaatttcctcagtcttcaatcttcatttattaattgatttgtttatcttcaaccatgtgttgaaagccaagcacttctttaaacactgggaaataaggcattattttctctgattgccaccatgggagatatgacaaccatgaaaacaaatcattataatacagttttctggacaggatatttaaagtatttataagataaaatggtggcatagagagtaggtaactatttgaaaagttcagagaaacttacgaactttgacttttctttctttctttctttctcgttctctctctttctttctttttttttttttttttttgtgagacagtatctcactccgtcgcacaggctggagtgcagtggcaccatctcagctcactgcaacctctgcctcccaggttcaagcgattctcctgcctcagcctcccaagtagctgggattacaggcatatgccaccacgcccggctaattttgtattttttttggtagagacagggtttcaccatgttggccaggctggtcttgaactcctgacctcagatgatccacctgcctcggcctcccaaaatgctgggattacaggcgtgagccaccttgcccagccctaactttgatttcttaaggcagacattaacagatagatatggatgtgtgatggaacattccagaaagagtgtaagaccttactatttccatatcttcttcccccgacctttttctgctttctcttattttatttcaaaacttgaaaggcaattttcttcacaaatatgagaacttgcccgtgaagcatgtgttggctgctttgtcttctgtatcatgaatttctgtttatattattacttcattggttcttcatttatctttatttaccttattgacttgaacactaaacttatatgcatctttctctaagtaatgctttagttgcttactacaaagtgtgatttgtaattatttcattattattacatttaaatatattttaatgttcaaagtgatatattttctgaaacccaaaaatctaagtgcatgtcttttaataatgttttaaatttaaatttttaaattttaaatatattttttctttctcactgtattacaaaattattataaattctattttggtcagaaaaaatctattattattattatttatttctattatttctatttgaaaatttgcattttagcctaatacctggttaattgttataaattattcattgtatttgctagaaatgccatgatacaaaataccacaggctagtggcttaaacaactgaaatctgttgtttaataataatggatgccagaagtctgagataaaggtattagccaggttgcttcttctgagtcctctctccttggcctgtggattgcagtcttctctctctgtcttcacatggtcttaacctcatcttgtctgtgtcttgatctcctcttcctacgaagataccagtcatattagactagggtccaccctaatgatctcatttaaccacagttacctctttaaagactctgtctccaaatacagtcacattgtaaggtactagaggttaggagttcaacatatgaattttggaggggacataaattcaacccataacatccacagattttgaaaaaaagtttgcaactaaatttcctatgtggagagatctatttatgagtattattattattattattattattattattattattagagacaaggtcttgctctgttgcccaggctggagtgcagtggtggaatcacagctcactgcagcattgacctcccatgctccagtgatcctttcacctaagcctcccaagcagctgccaccatgccgaactaatttatttactttttgttttaaaattttaatagagacagaatctctctatgttgcccagcttggtcttgaacttcggggctcaagcaatcctcccacctcagcctccagaagtgctgggattacaggcacgagccaccgtgcctggcttatttatattatatcaatcaatcttgctaattgtgttaaaatatttttgtccttattaattttttaccttataaagacattcacataaaggttgcattgaaatctctagccatatgaatttgtgaatatttctatataattctctcattttttgtttatatacttcgaggctatgttattacctgcatacaataatttttataataccatggtaaatatttcctttttttttttttcttttttgagatggagtctcctctgtcgcccaggctggagtgcagtggtgtgatcttggctcactgcaagctctgcctcctgggttcatgccattctcctgccccagcctcccaagtagctgggactacaggtgcccgccaccacgcccagctaattttttgtgtgttttttttttagtagagatggggttttgccgtgttagccaggatggtcttgatttcctgacctcgtgatctgcctgcctcagcctcccaaagtgttgggattacaggcgtgagccaccgcgccctgctaatatttccttttgaaaaacgttagtagatgtattagtcagggttctctaaagggacaggactaataggatagatgaatatatggagggatgtttattaaggagtattgactcacacaatcacatgatgaagtcccacaatagaccgtctgcaagctgaggagcgagggaaccaggccgagttccaaaacctcaaaagtagggaagccgacagtgcagccttctgtatgtggtgaaggcccaagagccccccgcaaatcactggtgtaggtccaagagtccaaaagctgaagaacttggaatctgatgttcgagggcaggaagcatccagcacagaagaaagataaaggccagaaggctcagcaagtcacttcattccactttgttctgcctgctttattctagctgtgctgatagctgattacatggtgcccacccagattgaggatgggtctgcttctcccagtcgactgactcaaatgttgatctcctttggcaacaccctcacagacacccctgggaacaatactttgcacccttgaatccaatcaagttgacactcaatattaaccatcacggcagggtttaccttttcctttcgctatatatatttttattaaagtttatttttttggataggggcgttgctattccaaattgcctttgttagcattcttttgatttatctttttcatttctttagtttcagctattttgtttctttatgttttgtcccttctgaacatcacattagctagatattttcaattaaaatcttttaactagtgtatagtctgattacttatttaattgctaaaatatttatgtttgagtcgtgaaatttttactttattattatttaccttgttttgtatttgctttatttttttcctttactcacatttctttattttactttcctctctttaccaggttgaagcttatgtattttatttttattctttcagtggttacaccttacatgtttgatgtgaatgtttggcttattaaagtctaatgttaattactacttgtatcttctttaaaaatatgcaaggttcttatagtgcttgaattctgatcaccaccctctcattttatgtatggtagtccccccttatttacagggaatactccaagactcccaagcgatgcctgaagcctccctggatagtatcaaatactatatatactatgttttttcctatacatactatgataaagtttaatttataaatgaggcacagcaagatattaacaacaacaatagtaaattagaacaattataacaatgtgccagtatcactactcttgcagtttgagaccattattaattaaaataagggtcatttgaacacaagcacggtgatactgagagagttgaggtgataatcaagactgttacgaagtgactaaagggcagtgtggatatctgaacagagggatgattcctgtcctgggtgggatggagcaggacagcacgagacttcatcagaatgacatgcaacttaaacctatgaattgtctatttctgaaatttcccacttaatattttctgacctcaattggccataggtagaatctgcagaaagcaaaactgactactgtattgctgatttacagcattttaatttaacattattttaacattatatgaatcattatactcattattttataaagttcatgagctatagacagaatgtttgtgtctccaaaaattcatatgttgaaattctaattcccagtgtgatggtgtcaggaggagaggtctttgggatattattagctcaggagggtggagccctcaggtatgggatttgtgcccttacaaaagagacccaagagagttcccttgccccctcctgccatgtgtggatgcagtgggaagatgctgtctatgaatctgaagcaaatcctcaccagatatctaatctgccatcaccctgaccttgcactttccagcttttggaacaatgagaaataagtttctgttgcttacaatccaccctgtttatggtattctgttaaaaacagcctgaacaggttgacaccatacttatatttacccatacgtttaataacttctgcctacacttctttggaattcaatttccttcttcgggattcaatttccttcttcaacaggtatgacctttctttcagagaaggtttgtaagaaataagttgagtttgcattgggtagagaataaggttattttatccttacttttgagaatattctcagatatcagttattttatcaggactttgaaaattgctccattgttttattgccttattttcactgttgaaagtctgctattgactgggcatggtgactccttgcctataatcccagcactttgggaggccgaggcaggtggatcccttgagtccaggagttcgagaccagcctgggcaacatggcgaaatccaacctctacaaaaaaatataaaaattagctgggcgtggtggcacatgcctgtagtcctagctactcgggagcccaaggctggagaatctcttgaacctggtaagtggaggctgtagtgagccatgatcataccactacactccagcatgggtgaaagagtgagaccctgtctcaaaaaaaaaaaaaaaaaaaaaaaaaaagaagagagagagagagaaaagaaagtctgctattataagctatatgtcttttctaacacttaatttctccttatctttggtgttgggaagtttttatctcatatattgaggtttgatgttttgttttgttttaattctgcctaaaactcattgtgctttctaactttctatgctgaaaaattctcagccattattcctcaaatattgctattccctatctcatctgttctctttttctggtactccatttacacacctaaggaaaggacaatcatttccaagagattccttttatttcagtctctccgtgttttggacatagggtatttttacaaagttacataaccccttaaaagaatgcttattttattttactcagtcacttttaggtattggtagcggaagagttttagttttactatctggaaccagggattgggaactaatcttcaaaccttctttttttatggtaggagaatcttctaaaacataaaatactattcaaaagaacactatataaaacagggaaacagaggaaatgcttaggttaaagtgaatatacagtggcacgtcttcctttttgcctgtgatccctgacatcactccaaggagcggtagagctccaaggaacacactttgcaaacttctttaatgggatgaatttattttcataaccttttgacataagcctgatgccaccaaatgtgcaatggaattttagttgggtgacctcgatgatagtctcaactttgctattaattagctatgttaaaataaaaaaaaaatctttagacaaattacatttcatagagtttaattgagcaaagaatgattcacaaatcgggatgccccagaaccaggatagatgtgactcaggaactgccacatgatcagataacatttatggacagaaaaaggaaagtgacatatggaaaatgaaagcgaggtaagaaggagctgggttagttacagcgcagtgtctgccgtatttgaacatggtttaagcagttggctgcctgtgattggccaaaatcacattggctgctatgattggctgagactctgctacttgtcataagatcaggtgcggtctgttcacccttccagttaggtgatacttcactatgtatggagaagcttttaggcctaacttaaaatacgtaaggaggaatctttaggctacacttaatttaacagccatatgaccttatgcagtgcactcaaaatctctggaagtcagttttctcatttttaaaaacagactgttggactaaatgatttctaattgcccctttttgaaatattctagaattgttagtgttcaaccagaaactcttctagcataatattctggagataccaggaataagaatgccattctagtactaagttaaacacagttctctctactatttatactctcaggattattcagcaatttattttatgtagcttgaccacaagatatatttaaaatatggatttaaatttagactttggctgaacattcagaaattaaattcaacctatagctatatatgaagctttatgattaaaattagcttaagtgataaacttgtgcacacagccaattttaagtttaatataagtggaagggaaataatagcaaggatgggttttgaaaagatgtttgtaaaagaaattcctcacgaatcttattcttctttcagccatcaccacaattggtcacagtattcaacatctaagaagaagtcttcagaatataaatttctctttagtaactatgccaacattcaaaacaaaaagatttttaagagggcttcatttttctccttttttactttttagaagtaatcatttctgcttctgaaacaagttcatctaagtttattgtactactctggatagagattaggacataacataagttagctgtgttgtagcttatttaggatacagctaatagcagtagaaaaagaactgaaaatgttggtatgatacagtgttaaattatattttgcaagctttagcttaaagtgtcccttatgttatcatgtagttttctttcaattactctttgaagcttcattttaatgatcaaatacaggataaaacatattatttgtaaaatgggtcagacttgacctgaagttgatgctgtaaatgtacaaaaattgaatttgaaacacttttaatatgttgggttatactagggaggtccatactgagaaaatacacatttttccaaattttggatgtaatttcttacctttttctgtgatttcatattcaaattggttatattagatttgcacacctataattatcatattttatcccatactggacttctacttagaagctattcatttaagatggtgtttagaattcagttagctaatgattaagcattcatattttaatattttattaaattagaagtaaatgaccctaaattcacatgtgaaaacttaagatgatgaattaggcctattttatgtcaggaaataatgtttgttatgcagtccactggattctcagggaaattagagtaaagagacctctctctaggagttaacacctacctcccaggcagaaaggttgaacaatctatcaggaaggtcagatttttaatcccagagaatattcagtcaggaagcaatagatatttgttcactgtgcccactccactcgcacccattgatgtgaacaaccataggctagaaaccactgcaactgtcataaagcacttggtggttttgctcagatttgttataaaaataaaggaaattgaattaaaattcttataacagttcttacatacatatagaaatgagcaaatgtcagctgctttgtaaaattctttatataaaaagaattttgtatactctaatttgtaaatagttttttgaaagaaaaataacaggcagactcatacggtaatctttttaacaggttctgggccactttaagaataagttgggttttttcctgtaaagttttccagtttttattggcagatgtttcttatcatcagatgctattaagtagatacattaagatacacatcatgctttggtattcaatgaacattagaatctttcaaaatattagatactagaaaaatacttaatggtaaagccaattaagtccattccaaatcagaaatactttatgagtttctttaaaagttattctttcagcctataccagcttaatagaaatgcttgagtgattaaatgaaaccctgtcagttgttgcgatggcataaatctgcagagatttcttcagtcagcttatcttatatgcattctttgctattgttacagaacataactttccttttagggacagaattttgtaagagattcttaatggtattactctgaataaatagatgtcatgtgggtgaataatgtttagagtctgtcaaacactaccaagaaatttttcttaacctcaatttcccgtaagggcaaagagaggtgattgcataaaaatgcaggttaaattctaaattcacggtttataaaatcaattattttcaaatatctttgtaatagaaggtagaatgaagacgtaaatgactttattaaaacgtagcattatgcacgcccgtgccaggttttctgttgtctctggttcatcgggaagtatctgacatagtgactgactacacagatcaggcccagcttggacaggctctgccactcaccagggtttgaccaggtgaaaccgccatgtgtgttcgttaaaaaattgtggaatgtcggccatttcatattgctcaagctaataagagtgtgatcgtgggcaaattgtttaatttctttagggctgaatatcctcacttataacttggagaaaataaagtttatttcataacattattacaagaactaaatgtaatatgcatataaaataatttgcaccttgttgagcagataatagctgtttcagtagaaggtaactattgttatactaaccctactgttaccatagcagtagtgtagggaggtgaggaacactgttatcatggataaaatcagtgttagagagagttcccttaggaaacaacctgaagtacccacatttccttcttcagttcaagatacctgagtttctgggtcttccagagaagagtatggctaagttctcatttgctgacccagaagaattctttcccagctttatgcgtgggcgtctattgaggttgcatttatggcttttatttcagtttgaggggattcaagacattgacaagaagggatttaacctcagaatcttatttttggtgagttaaaaaaattgtgtcttatctcacattcactagttcttttattttctagattcctcttaggactctagatgcacggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcggtatgtacctcataaagttaagaaatggaatattaataacaacttttaacataatcttcgcataccagaaggaaacaaatgtgcccagcacataatacaaattttagctgctttaaaaatcgtttttattatagacctctcctacccccttaaggaaatcaaagttgggggatttatgtaattttcccaaaatgttggttaggaaatgaggaattggctttagaacccaagtctcttctaccaaagccttgtttggatgacattccctcctatatttgcccataaagcctagcatttattactctatataatattcacctatgtacttgtctactttttccaaactgagggcaacttgaaggtatgggatgctttttgttcatccttttaactccaatccaaacatgtattttgtgaataactgaaagagtttacttcccccatattcttttcaattgatactttgagggaacttagcaatgtttctgatttttgctttatccctggatatggcttttggcaacccttagttaaaatctcagcacctcccagagaccttgtactatgaaatcctcatccctagccagtgctgttgtctctcaggtcatagctaaaaccaaccccttgactgaggagccccagataactatttgcttggtctgaattgtggccaggagtgaaaggagaaaaaatggaaagaaaacatgaacaatccactctagcagagaaatatcaataggcacagagaaatattgtagtaactggcataagaggtcatgcctaaaaagaacgagtataatgcttgttgcttcattggagccatgaatgtcttctcagaggctctgcagcattttactcgagaggtgagacaagcatcagcttggttcaggtttgcactgatgtttgaaatttgtagtaggagatagatttattatttaatttatttatttagatttatttcaggtttgaatcaattcaccaagttttgaaataatcatattcctttaggcttaaaatttattaagttagtgtagctcattttggtttttgttttatgcttccacagaggtccttggttactgttgagtgatcagccatggttattatgttgaagatgctacgttcgcatcttgctgtctctcttactactgctctgtaggaaatccagggaccaaacaggtctttattatgattatcagcactgtttactcaaaaaaaagtttactgaatgccttctgtgggccaggtattggaggagacatacaataagcaaataaatatgtcataagtcaagggggtgataattgctataaagggaaaataaagcagggcaaggtgagagggtgcaaggtagtaggcagctgtaactgccttatatgggtggggcggtgagatttgacttcttctgttgagttagcatttgggaagaaaccagaaggaagagaggaattaagccatgtggtcaactggaggaagaacattccaggctgagagaatagcatgtgcaaaggccctggggaagaacacttgatgtgattgaggaacagccatgagagtggaggggaatgagtcagagagcaagtggtagaagtcagtgagcagctggagacctggtgaaagacttttgcccttggaatggtggaggagtgacatgacttgctcaataggggaatggagagaaaagaagtgaaagcaggaagaccaaattggagaatgctgagaagaatccagtgtgtcacagagagtggtggcataggttgaggtaggaccagcagaggtcatgagaaatcatcaggctgtggacacattctgaaagtaatgccatcagggttgacttctgcactggagagggacgtcaatgatgattccatagccttggggctatttggtacattagaattgctattaactgagatggaggaacactgtgtgaggagaagctttcatgctgagtgggggcagcaaggaaaaagaggcaatgcgtttttcattttaaagtttaaacaaatctagctggctttaattttggcatggaaggtcttacattaatctgctgagattttcttttggaagacaaatcttctctttaaggcaacgagtatgacttttattcatcataacttagagggacaataaattgaaattggtcatgataaaatacaaaatctctacagtcagtctgtgtatacaactgcctcccgtccttaaataacaagggtgattttgtggtgtaaagtcagggagcatatggttaatgtaaatactgaatgagctatctgggattttaaaattctgggcttagattagattaatggaaagtatttactgaggacccaagtactaccttttggataatttagatcagggattgaagagtggcttagaagtgtactgagagaggtcctggctgctgtggtggctcggaatgttttgatggttttcctgtgacacatagagaagagatcatgcatggatgaccaagaaacccctgcttcccctgcacagagatactcactaagcatcaatgcttatcttttcctctgtatgtgagtaactgaaaattattgaatttggatttactttttaatctattggcttgaagtccactttctttaacaatgaaattgtcctccttattcaatcaaagccaccagaaacttgaatctgtcataatgtttagtcagagtagttgggaggcaataaagcccccacgattaatgttcccataggaagtagccacagtgacctcctccagcactcatgctaataaggcttcctgtgtccttgtctgtgtggaacaaatgcctcttcatcaaccaagcaccaccaaggctgaaattaggaaatagagccctaggaataacagacttctataaggaggtgagactctctgaccagcagcctcaacagagtaatcttgtttctaaacatagaagcaattttagggcctctttcagggcagggagacaattattgccaaaacaaataaggcagtgtctctctacctccggcactgagtgaattccgtctgagtaagggctgtagccggaacagcagcacatcagtttggctggaccgtcctaggctaaggacttctctggattgtctttgaacagtttaagtgtgtcctcttaattgatggatgagctaactaaagcagaatgggagacacaggaggagtgccgtgagcttcacacccatttgcctaacaacaaaaatgtactgtattcactagagatggaagactttcgtcaagaatgttaataacatttgaaacttcaggatataatttctaagatgtctaaaaattctgattatgccctgaaatgatcacttcaaatgtatctgagtgtcacagaaagatggattatgttcttctcgccaattaagttagaactctataaattgaataaatgcagtttccacaaatagctttggtgagcttccagactgttgctcattaatgatcacttaagggcattcttttggactccatagcatctacctgcatcgaagtgttttttttttcaggattctaccctccactcccatcctataatttaactccaggatcttctcttttatctccacccatccatagtaacttccacattggagttttaagaaaatgaaaggtcaatctggcttcaaaattcatttatcttcttgacccttgccttttcatcttgacactcttcgactctggacagcctctgttttctttcctctctacttttgcttctgggcttcaaagcaaaccacagtgatcttttccacttttgtgtacatactcaaggtcctagactcacctccaccctcacatttacccactgacttcactttctattttaatgagaatgagatcacttcatgggaattctctctacttcattgctcattgcttctgtcttcttaattatcctgtcttcttttgttcattctctttttttcgcttccttgtaacaaagtagaaattcagtaagcatttgttgaatgaataaattattgcttcttgatcccagtccctcaaatggtagcactttgccctgcttcttcctgccctgcatgaaaacataattaattttatctgtcttaacagttttctttttataaaagacaatttttttgattatgcttattgtagaagggaaaatacaaattttttaataaaataaaaactactccatagagagaaaaacattgataacatttggtgtatttaccttttaaaatgttttcatgtattttttcaaattaaatcactcctttgtttatttaaaaacatttctttaagactctaatttctcttacttgttgcagtgcttcttcactgagtcatttaaagcaagtcacttaattttttaaagcttaaattcatgcatctgtgaaacttgtaagacccattgtgttaatccattttcatgctgctggtaaagtcatacccaagactgcgcgatttacaaaggaaagagatgtttaatggactacagttctatgtggctggggaagcctcacaatcatggcagaaggcaaggaggagcaagtcatgtcttaagtggatggcagcaggcaaagagagagagctcgtgcatgggaactcctcttttaaaaaccatcagatgttgtgagacttattcactatcatgagaatagcgaggggaagacccgcccccataattcaatcacctcccactgtgttcctcccatgacacgtgggaattgtgggagttacaattcaagatgagatttaggtggggacacagacaaaccatgtcacccacttatataattatagtgtggagatcaaaggtaagaatttagtacacagcctggcacatagtaaatgatgaacaaacattaacctttgtgatttagtttctcttttcacttttaaacttctttaaaagtttgtcttctttcattacctcatcgttatcaactattcattcctttttcttgaataaccaaaaaaaaggaagaaaatacaaattgtcaatattacgaatgaaaggaatatagccacagatcctataagcgtaaaaaataataaaatatcataaacaacctcatgacaacaaatttgagagtgtaaattaaatagacaaattcctttaaaatttcaactaaccgaaacttactgaagaagaaatagaaaatgtgagtagttctgcatttattggggacatttaatttataataaaaaaacttttcacaaaaaaaactttgtatccagattgtttcaacactgaattctatacaaaatttaaggataaattaataccaattgtatacaaactctttcagaagacagaatagtaagtcacttccaactcatgctataaaatcaaaacaaccctagtgacatacctcacaaatacttttttttttttgagacaaagtttcgctctgtcactgaggctggagtgcagtggcaccatctcagctcactgcatcctccgcctcccgggttcaaatgattctcctgccccagcctcccgagtagctgggattacaggtgcatgccaccatgccaggctattttattttgtttgtattcttagtagagatggggtttcaccatgttggtcaggctggtcttgaactcctgacctcatgatccgcccgccttggcctcccaaagtgctgggattacaggcatgagccaccacacccggccacaaatacattttttaaaaaggacattacagaccaatatagcccataaatatagaccaaaaatactcccaaatattatcaatttaacctagccaatgaagtttatcctaggaatgcaaggttgagtcaatatttgaaaatatatctgtgtaattggccacattgatagagtacaaagcaaaagcaaaagatcaccttaaaaatgcagaaaattcatttgagaaaactcaataaccattcataataaacattctagaaaagctaggaaaagaagacaacttctgcaatctgattttttaaaaaaagcatctatgaaaatctatagctaacatctttctcaatggtagaggattgaatactttctccctaacattaggaatgagcttagtatatccattcacagaactgctatttaatattatattggaggatcaggagttcagagaagattggtgttactaggtgttattagtgatacttgaggatggctaaggtattttgaaactatgaagtatgcataggcagaaggaatacaggaacagtttgactaaaggtttaaaggcagaattaaatatagtttagtgataataaattggaaaaatatgttaggtataggtaaaaagtaacttcctattcttattataatttacgtcaaattttatttatgggccttgtattagttttcttctatgttatatcacaaaccacaaatttagcagcttgaaaatacatgcatttattattgcacaatttctgtgggtcaggagtctatgttatatcacaaatcacaaatttagcagcttgaaaccacacacatttattattgcacaatttctgtgggagcaggtttctgggtcttctatggggttcaatcaaggtgtagcccatgactggtttctcatctgcaggctcgattggtgaagagctcacttctaaggtcagtcaggctattggcagaattcaattccttgtcgctatgggattcatggcatcttggttcttcaaagccaggaatggagggaaagagatactctaaaatatctgttagcaagttagtaatataatgtaacataaccataagtgtgacactccctcatctttgctgtattctcttggatataagcaagtcacaagtcacccacccttgagaggagaggatcatacaggcatgaacaccaggaggcaggcatcatgagggtaacttaaaaactgtctagcacaagccttcatttctgctcatcagtagaagtcatagagatgatctgaagtattttaatctcttctgatttaaacaatattctttgggtgaactattcagtccaattagactaatttccatctattcagtccaagtagaaaaatatctgtctgttcacagttccttatctgagctttgtcttgttgtcagagtctgtcttaacctttcatctttgtcttaccactaatttaacagggtccatgtgggaataatcccaaagtgaccagaaagggagagaagacagggatgaaggtgaggtgggcaaaacatgtgcctacaagaccaggtgcaggccagagaaaagagcagaaaactcttgatactcaattggctccttcactgtagatgatgtgcgatttgagttcatttaatttgccacatgagatattcctagagcttctagatggccaccacctcaccatctcacctctgtggattctgtggtggatgatcctataggggcacagtggtgtactgtccagtgggaggatccattctacaccccacagactatgctggtgaggtaactttactctacagtattgcatttttggggagttgggtgctgtcaggccagtttattccttctactactttctatagccttctctaggcccacaagagacctaggaattaccaccataccaaacaaggcacctcaggaaaccaagggtgagctgtactctctcccatcttgctatgccacatgctacctctatgaagtctggcagtgctgggtaaggttggcttagcaaaagaaacaagaagcagagactagtttcttatatacagtgtcagtcctcaatatccagtgagattctcttggcgatcccctttccacgaggaacctattgaagagatgggagaggccgtgcatataatcattttgtcttagtctgttttgtgttgttacagcagaatctaacagactgggtaatttataaacaatagaagcatatttgcttcatggttctggatgttgggaaatccaagactgaggagctggtatcttgtgagggccttcttgctacatcataacgtggtaaaaggcatcacatgaagagagagcaagacagggctgaacgtccttttataaaaaacctacaataacaaaaccactctcaaaagaacaaacccactcctgtgataactatattaatccattcataagggcagagctctcatgacctaatcacctcttaaaagttccacctctcaacaccattgcactggggattaagttttcagcacatgaactttggaggatacattcaaaccatagcacctttctttccttttcaatcactgtcattcctaaactctcttctattttaaattccttgagtctaccctaataactttcctgggtaggggaaaaattgggtctttaggtttgtgtttcctcagcaacagctttcatcttctacctgctgtttcttcattaaatttagtagtttgcaaatttgtgatgtcttagatctatgtctcaggtgtgaaggctgaagagttagaagggggttgaagttatcttgggaacactggagaaagagaagcagaacatgtgtattgagttattgccataacaaacattcacattacttggcatttgaaaaaatagacttttgggggacaatgaaggagtgtgcctaagggaggaagttggcgccatagattggacatgacaaaggtgccaggctggggtttgccttggaagtctggcagaagaatggatgatgtgaattacttggactctgctgttagtgacagtcctgtccatcactgtttctgatattctgaaatttgtgatggcttagaaatgaaactaaaagcatttaaaaattttgagtagaaagtgaaattttcagacttaagggactttgaagtgaaaaaaaagttgaggcatagagctttaagagtcaatttccatcttcgttagcttttttttctttacttaaaaatatcatcttaaaaaaaaaaacactgagccctttatcacaatttttctccatactttcctcttctggtttatggacttctgcataggaattagtaaaatttgtaggcaaaactttagtttcatatgggacccatttaattgtgtaccttaaatccattggaaagctagaataagctttcatcttaagaaagttctttctgaagataatgggaggcttctgtttatggaccaacaatttgaggaatgtagtgatcacatgtatacaaataaatggctcaaaaaaggtcctcaataaatcataattatcacttattattgagtctagaatgataaaagaattaacaaaatatgttttataggcatttatttaatttaaataatgctttatctaaaagtctgaaattttgaatgatataagggaaattaaaataattgccttctattttcaattaactaccactataaccaaaccataaaaatgtttatttttttgaaatacgaattttggtaacatcctgtatgtctcaatgtagcctattgattaaataaattatataggtatttatatcatataaagtatgttgtcattaaaaataaatctgaaaagtaagtgatatgtgaaaatgctcttatgatgtctttaaaaagtttataaattagtatgcatagtataatttaatagttcagaaaattttgagaaatctctagaaatataaggcaatatgttaacaactttttttgtggtattatgaatcatttttattttaattttgcttttatatatctttaaatatttcttacataaatatgtactttaaaaatcagttttgttttttttttttaagagacagggtcttgttatgttgtccaggctagatttgaactcttgggttcgagtgttcctcttgagtcagcctattgattagttgtgactaaagacatgcaccactgtgcccagcaaaaattgagatttttaaaaaatcaagtttaaaaacatgtttttcacccaaggaaaaatggtacagttgcttctgaatccatggtaccgacaataaaatcattcaaaacatgtttttccttcgtaagattttgcaacaataagctcttgtctttatataaggttgagtaatttttatcaggttttcaagccagcattcattcaggaacattcagatttatgtaaaaccattttttttctcttgacaaagattagtctgtcttgaatgacattaaatgtcatcactccgggttcaaattattgtgcatttgttttctgtgggctggattttgcctaatcttcaatctgtaaatacactttaaaggtttgttagaacctggtaacaaattatttcattaccttgttgaagatactgacagtggcttttatttaatttcaagaacagagcatttgctcctctttttaaatgggagaatgtgtttatgatatttagaactgtatgctgactgcataggcctaggcttagcaagctttttacataggcaatttcagcatgtttcatatggagatttaaaaaaatctaaattttatgtgaaaaacaaaacattctagggtactggtttgaagcaataaagagatttgagtgtcactaaactggtgcagtaatgcattcctgtagccagtaccacttgtgattaaggaggatattgaatatgaagtaaaaaaattacataaaattatggattagctatatctttaatatttatatagcattaagtcacttaatatcaaaagaaggcccaatgatgaaaacataaactaataggcttggagttggtctgtatggggagagatactaaaatatggaaaagtaaaaaatagatggaaatacagttataatataaaagtaatttaaatatatatgtacacatacgtatataatgaatatatatgtacacatacgtatataatgatatatatgtacacatacgtatataatgaatatatatgtacacatacgtatataatgaatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtatataatgaatatatatgtacacatacgtgtataatgaatatatatgtacacatacgtgtataatgaatatatatgtacacatacgtgtataatgaatatatatgtacacatacgtgtataatgaatatatatgtacacatacgtgtataatgaatatatatgtacacatacgtatataatgaatatatatgtacacatacgtatataatgaatatatatgtacacatacgtatataatatatatatgtacacatacatatataataaatatataatatagtatgtattttacgtttcttatatacttagtatatattttattctattttcaactactttctttaataaatagttttccatgattatctcatagctttaaaacccataatttttaatgtttgtatatataatacctcatcagaaatagaagtttagctccctgttgctggatatccatagtgcttcaatttgtaggtaattataaataatgacataataaacattttcatataaacagatttgtatatattttctattatttataatagaatcgaattattgtgggagtttgtatcaatttatatcaccaaaaaatatgcacttattttagtgcgcctttattgttatcattttttaatttaacttttggtcttttagcacctacagatgcctcattctttaaggtttgtgtgagttcttcattttattgtaaattctctttttcattcagctataaatgtcttgtgaagtgtaacacgattcttactgcatgttgtaggtatgctatttcagaccacaaactcacgtataactttcttttttttttttttttttttttttgagacggagtctcactctgttgccaggctggaatgcaatggtgtgatctcggctcgctgctacctctgcctcccgggtttaagcgattctcccaagtagctgggactacatgcatgcaccatcatgcccagctaatttttgtatttttagtagagacggggtttcaccatgttggccaggatggtctcgatctcttgaccttgtgatccacccacctcggtctcccaaagtgctgggattacaggtgtgagccactgcgccaggcctatttttctataacataacttcacactgcacttatttcacttcatggaagaaattaaatcatcatcaactcaaagtaaactttactcccctcactggcacgtccctcagtaaattcagagtcttgagttcagtctaccctggtctccaagtttatatccatagagcaatatgaagtcttcttgtccaaatcacatcatgccaccattttaatccactgcttttaccctataataggcaagaattcaaaaatcctgacaacatgagtcatgccctctctcttggcttctcctataaagttaagcacaggtatcctctagtttcagatctctcaaaccttatttaagatcattcatcagcatcttatgatattatttctaactaaacatctcattatttcatccagggattttacctctcccaaggcaagggagaaacatccagcttagtaaacaatcttctaaatctccaaggtacccataaggactagaaacctgggcaactcatgaataatattatcaaagacattttcaatttgtaaatatatcgttagtattacctttgtttccagacatgtgggtatgcatgacaagacttcagcttttgaagttcaaaagtcaagaatcaaccttcttttatatactggggtctgtcaagctaccaaagtgaaataatctagccttctgggttgaggtgaggtgggtgggggggcatgggagaacacataggttaatacttctcactattattctagtatccacaataaatatttatctgtgttcttgagaaatggccagcaaaccactttcaaaatattacttttttattgaacacataggacagaagaagtgaattaagtctagatgttgacaagaaatctatagatatttaattttagttcttgctctaattctatagttagtctgttttaaatatgacatgggtgcttttgtttctttggtggctagaacagcgcctgccacctaatacatgttcaataaatatttgataaagaaataaatagtaggactgccattgttgggccctgttagacaggcagggtccccttggcagagacaaatctaaaggctatttgcagacatgatctaggtaagcatagctgtagagctgcccagatttatattccaaagagccaagatcatggctaagaaaacgatggcagtagttagaagagtgagatggcaataaaaatttgagactgaccacaaggcaaaacacaacacaatttggttcaaaactaggactgtaagtgttaagtacaagtatctcatttttttgcatgttgagggcagcttaaaggatccatgtcagacctgacctgttctgtgttttctggaactctgtgtgctatttttttattctctactaatctatgattctctcagatttaccacatcctttctgctatgtccctgtagctcatctgtcattgaagaataatgaaggaacatttgaatgaatctcctataatttctcataaatgcagtagtatctggagcaaatggaaagaaattagttaagaaatgaaaagtatggcatttttgaattctttgactcttcaattctcagtcaagtgatagcatattcaatcttttttttctttctcctgtagttaagtggtaaaagccatcttccttccatatgtcaattgttatatgtgaaaatactactgggaaaggtgatctttgaagttagaaaagtttgtttgctttttatgctaatattggttaaatatacccttctctgttttgtttattattttattaagaattgacttagagaacttcactttcattgacgtttcacaagccttgtctcagtctatgagttgcattcaataacttaaaatcattctggtctttttactaaggctcacaaaatttataatataggtccctactctcatttccttgtcaactcctctgtatttaaatatgaagatattttgactttaatacagcaagaccaacgtggtctgatctaatatatactatctctattatgaaatactcaggaatttattttgtgaaacaatctttttttcttaaacttgcatttgtattaaatacatttctttcttttgtttcatgcaaactgaatgattctctgctaaaatatacgttaaaatcctattcaaaatacatgagtttttagaagttttagttacagttactataaatcagaacatgtatagatttaacctattccaaatctgcctctcttttcagaaaatacatgaaatataatgggaagggttttctactcaagtaagaaggtagtcaacttcaaggaaaagtgggaaagataatctctaaatttgccaagggaataacttttaaaagtgcaaaaaaaagatatgtttagtggtattcttggagaattatcaggcacatttttattgtgatttaagaagtgacctttttataacttgaaattagtttatcaagtaaactttcaagtgaatatatttaaattaaaaactaaacacacacatacacactcacagacagagacacacacatgcacaaatcaaaaatgagttcattcttcatctcctgtaggtgttgatgtagactgtggttgcaaaatccagttataagaagactgctgaactttatcgatatagacactattctaatgctaccagtactcacagaaacattctgttgtattagctgttatgattctaatcaaattctatacttctgtgtaattccatgtggtcaaaaatttgcgtatttatgctagaatacagtaataaatttctttctagagctttgtttctgcctatggtactttatttttgttttattctctttgtattatagagaaatgtttggatttgaatgagggaatgatttgcattttagcttctgaattcttcattactgtgtttgttatgatcctgattttcatactttccatgtctgttttctggtttaaaaaactcacatctgtttttggctctggctttttgtccttcttgattaatttaattttaacaatatctgtgatttctcttctatcagtaaatgggccttgtcatttttcagagagcctcttgtttgattctgacctttggtacttgatatagttgaagtatttttcataatattttctatgggctatttactcattattcagcttttgcttttttcatgatctttatgtcaacttcattctaattaatgaatattaatctaatctaatatttttcattttactttgtactagattttttcatatgtcctcacttgtttattttatttaaaaataaatgtaaaaaatactatttttgaatatagtaacaaatgcaagtagcaaaatatgcatacacatgagaaatgtgttttttgctcagcttatctgtctattataaaaagaacacaaaaatattagagatagcaatggaagggtagggtatggccatgagttggggatagagcaagaagcagtatttgtttttaatattttattgtaagtctagagattttctttgatattcctttttcatctttattcagattggtttcatttttatcaaaagtaaaagtggaacagataatgactaagagttgaagattctaaaagaacacaaatctggagaatgtgtgtcccttctgaagtagagagctgattgccgggattcctgggtgacagacccctaagccagggcaggcatagtgccgtggctggaataaagggacaaataaagggtcaagacagacagaaagggttcatgtctccatggagcctggctgtgtgcaagacaatcagagaagagatcttcatctgatttttcatggagtcccttgtgctacctcatagtaggaggcaaaaaaaattttttttctttaaatccctaaacagagaagaaaaattcactgagagataaaactcctttaatgataaatgaattgacaatatttccggaattaatcttcttaatattcttaaagttaggttccagcattatttttggaaactgccaatgtgtttttcaacaaaatattttattgatctgttgtgtatcagacattgtgataggagtttgcgagggtctgccatactgtaataaaccgtacaggtagatccatgctaagaattaagagaaagagaggtaaggcagtgttgctatgctccttgaaaccacagtttctcctgaaacatcaacagagtgcctaagacataaaaggtgacaaacaactaattattaaattagtaaattgctgcagttaaaatgggttttatccaaaagacagggaataacaaatgctggcaaggaggtggacaaaaggaaacccttgtacactgttggtgggaatgtaaattagtacaaccacttcggagaacagtttggaggttcctcaaaaaattaaaactagagctactatatgatccagcaatgccactgttaagtatatatccaaaaggaagaaaatcagtatatagaagagatatctgcagtctcatgtttattgcaacactgttcacaatagttaagatatagaatcactctaagtgtccatcagcagatcaatgactaaaatgtgttatatataaatatatatattcaaaatatattgatgatgtgataaattatgtgtgtatacacacatacaaacacacacacacaatggagtactattcagccataaaatgaatgaaattctgtcatttgcaacaacatggagggcagtaaaggacattatattaaatgaaataagtcaggtacagaaagacaaattttgcaggttctccctcctaagtgggagcttaaaaataattgaactcttagagatagaaagtagaacaatagtcaccagaggctaggaaggatagtggggaagaggggataaagaggggacggttaatgagtataaaaatacagttagatagaaggaacaagatctagtagtcaatagcacaatagggtaattatagttaacaataatttattgtatatttccaaataactaaaacagtggaattggaatgtccctaatacaaaaaaaaaaaaaatgcttgaggtgatgaatatcccaattaccttgatttgatcattacacattgtatgtttgcatcaaagtttgacatgtaccccataaatacacacaattatattgcaaccataaaaattaaaaataaaagaatttaaaaatacataaattaatcattgcatattttatcagaaaacattatttagaggatctgtctctttctgtctgtttcctaacttatttttgggaagtttaacagtgtttcctagtgcccttaaggcctcagaatttttccctctggcttctgttgagtaagagtttaccgtgtgcctgattgggatacttgtaaggtctagatatggaagagcctcctcaggtgagtgtacagccctctttgccttaggtttgaaggctttctggatttgtagttttatactcccttaaatcatttttttagagtatgtagtttaactttacattttattcttatttattcattttaagtttattgaataaatatttatttggtactacctacgagccagactctgcaagattctggggaaacaacaatgagaataacaccaacattgtcccttgctgcatgccagggaacttacaagctagtcaaggagaagatgtgattcaaatgaatgaaggagaccttgaatcaggagtgttcttattttcctcacgttatattctcagtgcataggagggtattgagcagccaaataattgctataagtccatgtttaccgaatgaaaaaaggaataggatagaattttgttagaacacgttaaaaaagaaagaagaggaagaacaggaggaagaaaaagaaagaagaggaacggaagaaggaaggagaagaaaaccacttgacctaggaggtttttgttgtgttttgtttgtttttcctgatgatttgcaaaagactttcttgagcaagtgacacttgagctgagatctgaaagactgacaggagatggtacaggtagagaaaaagagtactccaaacagagggagtagtatgttcaagggccctgtggctggaaagggcctccaactgaatggtggttgctatggtgaggctgcagggggttgggtgaaaaggtgcttaatgtggctatagagattgccagggccaggtcatgtcagaccttactggctgtacattggaattttgtttgtatcctgaaagcaatgagaacaataaaagactctatttcctttaacaatttaacaatctggttgccagttattgggtctggtatattacttacttcatatttactaatttagtcatatttaccaaagaatgtgaggactattatacaattgtgaacccttcaagctagaaaattttctcaattgttaaatatttgaaaacagagattgtaataaaagtaaaagacattgtcataaaggcaagtaaaagattgtcataaaagacagtgaaatctaaatccttttactattaacataatttgcctttcagattactttaaacagtatttatgtagcaccaagcagaaaagcataagaagcctgattatctcttttcacatatatttttaaattaccatatatattacacataaaagaacttatctacaatgataggtgtatgtgtttcaaatgctacaaattttagaagagaattgcatttttcaggtcccatctcttgcttcagcaacattccaatggccccagagaaaacatggtcagtactgcaggtgactgctgccttcagttacagttcccaaatctgcagtgacttggcccgtcatgcaccagctgtgctagtgcccttgtctggcaaatatacccaactcctgctcttccctccaggcagtccctgttgaatcaaaagcccctctattacttcattcttcagcacgctggaaagcccctatgtcccactcctaaagcagttagagctgtgcattcctctctctcttccttgcttttcctgctaatctataggctcctggagggcagagatgcccggacctctgtcctgtcatttaactctgtgatttggagcaagttttaaagcctcttttagcctctgtctcatggtctgtaaaataataacaaaaaatacttctatagaacatctgtatgcccgcaattgtatctgttcctcacaacatccctctgagggaagcacggatatcacttccatttcagagatggaaaaatctgacatactgagaggttatttaatctgcccaaggctagatagctaataagtggtagttgaaagcgtggtagttgaaagcatggtagctggcaccaagtctacactattaacttctccgctgtgcaggtattacctatcatatggtcataagaacccttccttttactggatttttttttttttttttggagatggagtctcaccctgtcatccaggctggagtgcaatggcgcactctcagctcactgcaacctccaccttccaggtttaagcgattctcttgcctcagcctcccgagtagctggcattacaggcatgtgccagcaggccagctaattttgtgtttttagtagagatagggtttcaccatgttggccaggctggtctcaaactcctgatctcttgatccgcccacctcggtctccaaaagtgttgggattacaggcatgagccactgcgcccagcctttactggatttttatgacattatttttgtgaaaagtttcacacgatgccaggcacaaaaatcaactctcaataacaattatttatatttaattttcaattaaatttaatttttcctattttcagaagagactagtgaatttataaaaagttttcttctgatctgtgccttttattccttttttagtattttaaccttaatacaattaaataaatgaaaagctatatgcagaattattgtgttgtattttgttttgtttttctttagagcctcacactatttctatgactgaaaactacattctgtgtaaatgtaagtttccttttgaatgcattacaagtggaactgacttttccaattacctactcaattgacctggtacaaagaaggttaaagttccaacctaatatatgatcattaaaccttttcatgtagcttttcagacaaggcagtctgggaaaattcagagacaacatcatttttggtgccagactgataaagcatttagcatttgtcagttttaggagaaagagacatgttgatatattaattagacataatccctctctttggacaaaatggattggttctgtttttttttaaagtctgataattaaaggtacatgtaagctcagataatctaaaaaatcttctaaataatactagagcttggaaatatgtatcatatgtatacacacacacacacacacacacacatatatatttgggaaacacgcactgacaatattttgcaccatcatattgttaatttcatgactgataatttcaccaaggatgatttccaatgcctagtaccagtaaaggtaaattaagaaaagaagtttttgaaaaaaaacatcacttacctaggaaacaacttcttagctgccacatgcctcttcgactttgtaaacttttttttttttttttgccgatttccgaaatgttgcaaaaacaaacagtggtaaatccaataattgttctccaagatttgggtcttagttgaaatcaatcatgtaggccatttatctcctctttttccttctctcccccaccaccagactggtgtgggctggtgatatgaatggcgtttagccacatgtgtttcagtttggggatccttaaccataattgatgaaagactgttttcttttcctttaagacagataaacagcatgctttaggaactgtggatcacatcagtttatgtgaaaataactttaaattccatattttaaatattttacaagttttaaaacattgagttttatgcataagtattcagagacagcaaatgtcagtatttcatagttcagaaaaagactgatccatttttgtcagtttagagaattagccattgtaaacataacgtaaatgctttatagtatattatattattatgtaggactaaaatgcttaggaaacttgcatttctgttaacttacactttggtgtaaaccaaactagatttggtttcttaatgtatttcctgtgatacaagtaaaaaagaaatttttgtttgtttgtttgtgtccctggattttgctacatagtatctgatttcagaatatatagatggtggaaatttaggtttaattccagcaattcaaagtagctattgttaatacctctatctctctgtttgtccctccttctctcttcatctatctgtcagagaagaaaactgaggcatagaacatttgggaatgaatctaagactacacatctagaatagcagaggtacgttaaaacccaaatttcctatctttgattaacactctgttttaattgtaaaataattacatatttatttaattataattaacttaataatttcaactcgtgaacaagatacagattatagcatttccttgtatgtaaagtcttcatttgaaacatatattggtgcctttgtcggttacattaggtagcgacattcacgtggtaattagatgtagtatttaattatatcacagaatatataattatttctcttcattttgaagggcaaaatctctctttctgactttagaaataggacttggaaacgaggggcaaaataccttgggctattatctttgactttcattaaattttgcagacctcaggatattgtgtgccaaggtgctatgaaatattttattaaaaatagtcacagcatatgttcgtgttcatgttagctttgtattcattgattggaattatacagtgcaaatacttggagaagctgcatatgtgctaaactagctgtgagtcatgaatcctcctaactcttgatctcatcaggacttgtcttatcaaagtcagtgggagtagagattgtgaatcccctcccacgtgcattcagacacgcagggctagctttcttggcgctgctgatgcccaagataagaggtgatggtgaaagcttgtggctatcatgtgctttctgtggaaaaacactgtaatgtgttacacccaacatccacttctaatgacgtcaagatacacagctttctgttagaagcaggctgttaccagtgcagttcagatttggtctaaagacttgatcacattacattcttattctaataagaatatttcaattttaatattctaattcttagactacttaaaaagaatcctgagacaactcaaatgactcaagactatctctaatgtcccaatgttccacattttcagctggttcagtattaggaattgacacccagccagaaatgttcaatgattagctctttgtaaactacactgaaagagatctttagctttactgtacatgtttacaatgttttcttttgccaattggaggagacactggagcttaggatagactcatgcacagggtttataggatgtcagacaaaatgatttttattgaggaagggtcaagttgtgtttttcgttgtgtcacactatacaatatgagggccatgttataaaaattcagagctcccacaagaaggcaaaggctaaaaatggtgatttaagactacattatcctgtttctaattccttttctttcttcctgcggaaatgtaattgcagaagctgggagaagggattggagtgtgggcttctatatctgtcttgaagagagtcgtaaagcctgttttacgagtctctctctagcctcgttctagttttccaaattaaaggagacaatatgacaatctcaccaagctctgatcttacatcttaatttgcaaactcagcagcaatatcagtacctggtttaagtggctcagacaaaacagtgttgaaatggacttatccttagaaattcagtaaaaggtcctctgtactaatgcggagccatttttttttttttaaaaaaagaaacttacaaacattacaaaatttatttttattttttatttattatttcctaaaattaacatgcttaaagtcaatttcttagttttacaaatgtactgtagtaatgtaagatggtaacgatgggaggaactttgtgaaaggaactctatgtactctatttacaacatttctgtaaatctacaactagtctgaaacaaattgatgtactatcaataactacattgttcttgtccagataaaattataatgggatagcctaaagactggggtaaaatttgaaggttttttttttgttttctgcttatgaattaacagagttttcagggtgttgttgttttatccgttttggtgatttcaagaactaagggcatttttgtttcttagcatatgtcaggcaaaaggactttatgaacttgtctgaagcattttcaccaactgtttgtttatagtcaagccaaataacccttcacgtactatgtgaagtccccttcacctgcaccaactttgtcagagaactgagactaaaccttcaccaacagtgtaccttgagtatagcttcaaaggaccacccacttctaggggtgagaggctaaatccgcctctctgtccggcccattttaagccttaggaaaacaaggatttcatttaaaccttcccaaaccagagagcatttattaacagctatggttctaatatttggaacaaagtcaagatcaaaccttagtactatctcagcagaagaaagattagaattagtagttaatctcactgaaaatcctttcagtgagaaaaaaaatatgtgtgagctttaactacaatgattctctggctaatgagatgccattgatcatgtggagaggaaagtaatatcctttgacatataaaactgtatacagtggttatggaatctaaatctattcctttgctagagtgaaacattactaatgaaaacaaaaaaatgcattaacctgtaaaaagaaactaaatttattgacaagagtttgcaaatcacagttaattgagtctcagatgaaacttcaaataaaggaaataatgtggtaattgggcccctcatcttatataatatacttgttggcatacattatgggtttgctatcttttaagagtattaaatcattgtacaaaaacattgccaaaaagactcttcatttccttttagtgacttcttactgccctcagtggaagtttaatagaaaaggaaggacatgatgtagttttaatgacaggaaacccatggccttccaaatgaataaattccatcactagctgccacaaagtgtgctaattatttcctttgataaattaaaagctgtaaaagtccgaagtatataagcatgtggtttacagttataatcaacctgtctgcattattgaaagttcatattatcttcactatttaataaagcattaattttttattccaacaaattgtatagaaagcatgtacataaagcattaaacttttgctgatttgacagatgattaaataactaaactttgtgtttctgacctttaagatgctaaaatcaagtattgatttattcccctaacactaaaccttgaagatgaagatgaagatcattatgaaatgatgaaacaaaccaaatcaaaagccaatcatgtccaaagtgtgtagaggaattagaatattatacttgatttttattattttatttttaatatcagctaaatcacttgggagtgaaatacagcaattcaatcattcaacaaaatttatgtgccccatgtgctctgtgtgaattaatttgttaattccacaatcatttatttaacctttgccatgtgttctgggggtacaatagcagtaaaaaatggactccatccttgtcttcatagagcttgcaatatagtgagagagccgtacatctagtgattgtacaatcatcaacctggaaatgtgacagggaggtttatggcttgatgaaagcttactaaccataggagcactgtcctactcagtcatagacgttcggcttccctgataaaaggcggctcaaattgaaatatgaacgatgagctaaagagaacaaggagaattccaggcaggggtacaggcatatgtgaaaggctttgtggtgagcctgagagaaggtccatgtggcatcagtacaggaggtgaagtgagtcagagcccagcttgcctactcagtgtctctgtgcacctttttgtcaaagtgggtgcagactgcaccagggcacatggattgttgaacagcatgtgggctgtatttcggccccatcacctccttggctgagtgctcaaatgcatgaccttcgcattgtacatagcagccgtggggaaagtggagcaagctaatgtaacagtaaagaggttggtagagctcaagtaatgtgagacctcgcaatttggtagcaaataaaaaagagtggcttctactaagtttaatcctgtcaaaataatccatctttaattttgtacaatttctaatatttctccagtttcaactctaagcttttcaactaaggagaataaaacatctcactgtagtcatcctattttgtgctttgtcttgtttttgcattcaagaatgatacctgttgtgttctcagccatttgttctaactccatttagactggtgaaatgaaaaaaaacatttaatgtgacttattggatatacgcagttaaatcatggcttcataccttacatgaagggactatggttctgctagaatttaaattatttggtaacgttttacaaaagaactgatgatggtttcattctttcattccttccatttttagaaattcttaaaaatccatccagcatccactttaccaggtactctgagaggggcttaggagacccaagaaatgcatccaagtccctgtcctcaaggtactcactcactatgtgagatggtcacactaacaggtgattaagagacagcgacccatgggcagtagaaccccgacagagtatcttaattcagggggccagagaaaacgttccaggcagagactgtaaggatccctaagagcaagccgagcaaagaatagaagaagaggctttcaggctgaggggactacaggaacaaaagtaggggatgggaaaaacatgttgctggagtgtaagtgtaagaaaaagagaagcaagagctgggagcagagtgttgggaagggccagatcaaggggcttgaacatcaagaatcttggatttaattttgttggtgaaagggagctattgaagactcttgcttcttttggaatccacctagaaaggccttatctggggtctaggcctcaaattagaggtttttttttttttctttttacacctgtgccaagcatccagttgtttcataaatgtttctcagaataacacaatctgaacatggtgggaagactgtttaataactcagtttagtagagatttacagtttcaatatatcactgggatgtgtagatggaagaaaagtttgggagggccagaactccaggcacgcataccaattaggaagtaattgcaatggtttaggtaagagtcaataagaacaattaagattctctcagtgctggagagaagacaaaagcttttaagaggaatttaggaggtaaccaaaaataagcttcatgcttaattgaacatttggaggaaagtgggaggaagaaatcaaggatgtctcctcggcctctggcttggataatgtaatagaatatggaaaaatcagaagagataaagatactgacagcactaaggcattcataaattgagttaggaaaaaaatttgggtgcaacaaaaaatttcaataaatgtaaacttcatttctgtcgacgtgaaacggcacttaccgaacatgtaattgtccaggatgctggtaacaagaagcctctctttggcaaagtggtgcaactctcacaatgctcaggcaggcagcttcttggcgttgcccaagacaaactcttcctggacagatgcacgcattttctcttattctatctatatgttctttcttgtaattttagatacttactaatctcgcccaacctccacatccctgctttcccttgctccactctaaataaacctaatccttttaacttttactcagagaccttagtttgcaaactatgaatcattttgcttcttctcttgggatcccatccagggagcccatacttcatttttaaggcctcagatcagacacatttctctatgactgtgccttgaatgcagtaggtatttgataagttttttttttttttcaaaacgataaaatcctaaggatggtgggaagatggtctagtaactcccacttgctaaaatcctagttatttcactttattatcaacacatttttaaacattaacatggcattggtgactcatgtatgatcctctgtaattcttttttttatgctgtatttgtctgtaaccacgtcttcaacatcatttctgtatggtttgcttttccttttttcacttgttctgattaaatttttatttccattaattctgtttatttttcaaggtcatttaaaagtataattatcttctctaagttgctaagcttggaaaagataatttagcttggtgccactagtaacttaatgagctcctcccaaaattcatctgtgtcattaaagatgttactaaatacttctgacccaggatgattcctttgaaaagcattcatgtcctttaagctgaaattgtattgttgataattgactcttcttgaatattttctaacaagtttgtattctcatctagtagcaaaagagtttaaataatagctaataatagaataacatatgccggtatactattatgcttacaaaactttctctcaccccatattacttaatttgctcatttagacatccttgtgagacaggaagaagcgaagctatctttagagctatttcaaaggtatggaagctgagtctcagggtaagtgacttaacgaggtcactcagccagcagttagtagaacataactcttaagtgtatatcttctgacttcaaagccaatgtccttgcagctctaccatgcctaactgttccatttgtatattaatatgtggcttcagctaaattgaaacctttattaaaaattgctgacaaatctcttccaaagttgatttcaccgctctttttaaaaaatacttaaaattttaaaaatttttatattttatttatttattttttaactttaagttccaggatacatgtgcagaatgtgcaggtttgttacataggtgtatgttgtgccatggtggtttgctggacctatcaactcaccacctaggttttaagcccctcatgcattagctatttgtcctgattctctccctcccctcaccctccctccattaggctccagtgtatgttgttcccctccctgtgtccatgtgttctcattgttcaacttccacttatgagttagaacatgtggtgtttggttttctgttcctgtgttagtttgctgaggatgatgacttccaacttcatccatgtccctgcaaagaacatgatatcattcctttttgtggctgcatagtattctaaggtgtatatgtttcaaattttctttatccagtctatgattgatgggcatttgggttggttccatgtctttgctattgtgaatagtgctgcagtaaacatacgtgtgcatgtatctttataatagaatgatttacattcttttggccatatacccagttatgggattgctgggtcaaatggtatttctggttctaaatccttgaggaattgccacactgtcttccacaatggttgaactagtttacattcccaccaaataatgcaaaagtcttcctatttctccagagctttgccagcatctgttgtttcttgactttttaataattgccattctgactggtgtgagatggtatatcattgtggttttgacttgcatttctctaataatcagtgctgttgagcttttttcatatgtttgttggctgcataaatgtcttcttttgagaagtgtctgttcatatcttttgcccactttttgatgaggttgttttttttcttgtaaatttgtttaagttccttgtaaattctgaatattagacctttgatgagtaaactgcaaaaattttctctcattctgtaggttgtctgttcgctctgtaggtagtttcttttgctgtgcagaagttccttagtttaattagatcccatttatcaattttagcttttgttgcaattgcttttggtgatttcatcataaaatctttgcccatgcatatgtcctgagtggtattgccaaggttttcttctagggtttttatggttttgggttttacatttaagtctttatccatcttgagtgaatttttttacaaggtataaggaaggggtccagtttcagttttctgcataaggctagccagttttcccagcacgatttattaaatagggaatcctttccccatttgcttgtttttgtcaggtttgttgaagatcagatcattgtagatatgcggtcttatttctgaggtctctattttgtttcactggtctacatgtcagttttggtaccagtatcatgctgttttggttactgtagccttgtagtatagtttgaagtcaggtagcatgatgcctccagctttgttccttttgcttacgactgtcttggctatacgggatttttttgttgctgttgttgtcccatatgaattttaaagaaattttttctaattccgtgaagaatgtcaatggtagtttgatggaacagcattgaatctataaattactttgggcagtatggtcattttcacgatattgattcttcctatccataaggatggaatgtttttctatttgtttgtgtcgtctctgatttccttgagaagtggtttgtagttctccttaaagaggtccttcacatcccttgttagctttattcctagatattttattctttttgtagcaattgtgaatgggagttcattcataatttggctacctgcttgtctattggtgtataagaatgcttgtgatttttgaacattggctttgtatcctgagactttgctgaagtttcttatcagcttaaggagttttggggctgagatgatggagttttctaaatataggactatgtcaatctgcagagaaaatttgacttcctctcttcctatacgaataccttttatttctttctcttgcctgattgccctggccagaacttccaatactacactgaataggagtggtgagagagggcatccttgtcttgtgtcagttttcaaagggaatgcttccagcttttgcccattcagtatgataatggctgtgggtttgtcatacatagctcttactattttgagatatgttccatgaatacctagtttattgagagtttttagcataaagggatgttgaattttatcaaagactttttctgcatgtattgagataatcatgtggtttttgtcattggttctgtttatgtgatggattacgtttattgatttgtgaatgttgaaccagccttgcatcccagtgatgaagccaacttgatcatggtggataacttttttgatgtgctgctggatttggtttgccagtattttcctgaggatttttgcatcagtgttcatcaggaatattgacctgaagttttctttttttgttgtgtctctgccagatttgggtatcaggatgatgctggcttcataaaattagttagggaggagtccctccttttcaattgtttgcaatagtttctgaaagaatggtaccagctcctctttgtacctctgatataattaggctgtgcctccatctggccctgggctttttttggtgggtcggctattaattactgcctcattttcataatttgttattggtctcttcagggattcaacttcttcctggtttagtcatggatgggagtatgtgtccaggaatttatctatttattctaggttttctagttcagttgcatagaggtgttcatagtattctctgatggtagtttgtatttttgtggggtgagtggtgatatccccttgatcatttttactgtgcctatttgattcttgtctcttctttaataatttttttttcaaaaaaccagctcctggattcattgatttttctgaagggtttttcatgtctctatctccttcagttccgctctgatcttggttaattcttgtcttctgctagctttttgatttgttagctcttgattctctagttctttaattgtgatgttaggatgtcaatttgagatatttctagctttctgatttgggcatgtagtgctataaatttccctcttaatactgctttagctgtctcccagagattctggtatgttgtctctttgttctcattggtttcaaagaacttcctgatttctgccttaatttcattatttacccaggagtcattcaggaacaggttgttcaattcccatgtagttgtgtggttttgagtgtttcttaatcctgagttctaatttgattgcactgtggtctgagagactgttacaatttcagttcttttgcatttgctgaggagtgttttactttcaattacgtggttgattttagagcaagtgccatgtggcactgaaaagaatgtatattctgttgttttgtggtggagagttctgtagatatctattaggtccacttgatccagagctgcgttcaagtcctgaatatccttgttaattttctgtctcattgatctgtctaatattaacagtggggtgttaaagtctcccactattattgtgtgggagtttaagtctctttgtaggtctctgctgagaaatatgctgttagtttgattggcttctctttttaagtgacctggcttttctctctaacattttttccttcattttgaccttggagaatctgatgattatgatttttgggttgatcttctcgtggagtatcttagtggtgttctctgtttttcttgaatttgaatgttggcttctgttgctatgttggggaagttctcttgaaaaatatcctgaagtgtttttttccaacttggttctattcttccaatctctttcaggtactccaatccatcataggttcgttctttttacatagtcccatatttctcagaggttttgttcattcctttttcttcttttttctctaattttgtccatctgtcttatttcagaaagataatcttccatctctgtattctttcttctgcttgattgatttggctattaatacttgtgtatgcttctagaagtccttgtgctgcattttccagctccatcaggtcatctatattcctttctaaatgggttattctagttagccactcctctaaactttatcaagttcttagcttctttgcagtgggttagaacatgctcctttacctcagtgaagtttgttatttctcaccttctgaagcctacttctgtccattcgtccatctcatcctccctccagttttgtgcccttactgaaaagttgttgagatcatttggaggagaagagtcactctggccttttgggttttcagcgtttttttcattgactctttctcatcttcatgagttcgtttagttttgatcttggaggctgctgacacttggatgaggtttttgtggggacttttttttgttgatgctattgttgctttctctttgtttttctttcaatagtcagttccctcttctgcagggtggctgtggttggctgggggttcacttcagaccctattcatctggttcactcccatgcctggagatgtcactcgaggaggctgaatgacagcaaagatgggtgcctgtttttcactctgggatatctgacctcgaggggcactgagctgatgccagcaggaacgcttctgtatagaatgtctgacaatccctgctgggggtctcacccagttgggtggcatggcaagcagggcctgtttaacgaggcactttggctgtcccttgctggagggcatgtgctgcgctggggggaatcccatttctctgggctgtcctgattcctcagagctagcaagagaaaggatgaagtctgctggtccatggagactatggccagccatccccctaggggctcaggcccagcgagatcagagttctgtccctgagccctcagctggaactggagttcctgcagggatgccctgcagcctcagtgttggctgccgccccctcccacaaagagctcagatggcttagaccacaggcagctgcagcagtaattatggctgcccctcctccagggaacttggtaggcttaggccaattttagctgagtgggtgttgagaatctacgtggctgtatggttggggcccaagaccctggtggcactggctccggagtgggatctttcgatctgtaggttgcacagttctgtggaaaaagcactgtttcccaggctgggtagcacgctcactcaccacctcccttggctggtgttgggggctcccctgccccatgtggctctcaggtgggctgccacaccacactgctcttccttcctctctgtgggtcacgctagctgcccagtcagtcctaatgacagaacctggatactttggttgccagtgcagatttcgcacactgttttggatcttttcaatgggaacctctgatggctgctgcttctagtcggccatcttggccccgcccccacttcacctctctttaaattcctaatgcataattggtctgtgcaacataattcaattatgtgtgtaaggtactggacctaaatactgatggatacataaaataattgtgacactattcctgaagaaggaataatcttctgatatgaagccaaggaccacaaaaattgcaaaaacattgtatgatgatatctagcactttttatgtgttgttttgcattttactgttcattgctttaagacaaataactcacttcttgaggacagattctatgtagtctacatttgaatcctcaaccacacctagcaagttctcaacaaatagtacagatttttgagtacttgtaggccaacttattttgctggctgaacttcaattatttgtttaattcttgctatgtgtccagtgctgtactaggcataagatggaatgcatacctttgtcttttgcaaagggaacactaacgaacaaggcagttttgtcagacactaagtatactccttgactaggctggagtaccaggcattcaggtgagtaggaaaggggaatacgtttggaaacatcatgttggtccatgttatagaagaccttgaaagtcaagcaaaataggctagacttgatgtggtaaacaggaagtctgatttcaatatcaaatagagtcattattaaggatgaaaagaaatgttaagattacgtcatcaattgttattttatcaattgtttttattgtgtaataatttaattattgcacttcatattacttgagaaataataaaatgaagaaagaagcccttcttacctatttgaagtgaaatatttgtatttgttttccttaatgttatttctgtccacctgcctagaaatccttaatctagcacattcgtggtattacttttttttttttttttttttttttgcttctcttccacacatgtatgtcttctggatctaatagactgtttcagtcattacttgtgtttgtaaacagctgttaaattcatcatgtcttaagtttaaattatttgagttccattttgtcctctgatcaattgactcatccattcatttgacaagaatgtagagggaaaattacatgccaggaatctgggttctgtaggcaatattaacaacaaaaaaagacagttgaggaccctgagaagcacctgcactgataatgcattagagggtgatgtatgtcaagtcttctatagtctcaaatttaagaataccatcatagcatattttttactccattaaataaagaaacatataattaaaaatatttaatcatctcattcctgtattcatgattctaggtagagttagagttacttttttcatgatattaaacaaagccattcacatggatgttgggcagtcggctaggttcactcagtggcaagacttttgttctcaaatggcccctctgttttaaagattctgccgcaataactttcaaatgaccacatgtcatggaacattgttatcactgaatatagtaaaacccataaaggtgaaagctgagaatttttaggcctactgaagtgaggaataaggttgtacttgcacagagtgacccattataaagggctctaaaatgcactgcaggaaatttgaatataacgggacaagtaatggggagctactgcttgagctgaagtagaacataatcaatacatttggcaattgcaggctaaatattattgaagtaacagagtcaagaagagcaggaagaagactaacactgtggttctggcatgatgtggttagatagctaccagaatattagcagtgaaaacagtaatgcaaacataaaacagttgcagtgctgaccctccaggggcttgcagtccagtgggagggacaggcacataaataacctagcacaatagaagaaatgatcaatgagagatataaactggagcccctgggagcatagagtatggctgaatatggagtaaagagctcacaagtcatcaaagcagtgcatggtacagataggggatggggagcattctgagtagaagctgccagtggaatgctggtagataagtctaggtgcaagtcctgatgggactggtgtttttgctaagtagcttgtcctataaattgagccatatcacaaattagaatcatgtgattccatttgcattttagaatcatactgaaagtagtatggagggagcactgccaagaccagctcggttgggataccctaacccagcggcgctagaggaattaaagatgcacacacagaaatatagaggtgtggagtgggaaatcaggggtctcacagccttcagagctgagagctgagatcatcgaacagagatttacccacatatttattaatagcaagccagtaataagcattgtttctgtagattatagattaaaagtattccttatgggaaacaaagggatgggctgaaataaagggatgggtttggctagttatctgcagcaggagcatgttcttaaggcacagatcgctcatgctattgtttgtgatttaagaacaccttgaagtggttttctgccctgggtgggccaggtgttccttgccctcattccggtaaacccacaaccttccagtgtgggcatcatggccatcatgaacatgtcacagtgctgcagagattttgtttatggccagttttggggccagtttatggtgagatttgggggggcttgttcccaacaagcacagatggaggaaagaatcagcatgtctagaggcaagaggacccccatggagagaatagcctaggttgttgtttggattcaataaagtgttgctacatgaagagctccaagaacaacctctggtatgtagtaggctcttaatgaatgtaggttctagatttactattattagtgttcgattagtcctatttgtactattgcaatagtcttggtgagaaatgagaaattattagaacatgtgctaatgttccagaagtggtgatggggaggaaacctagattctggaactatcagggtgtggggtgggagagacttgaattaggaagattctgcttagatgatggggcaaggcaggaggggtctgggatgtgctttgagactttgaatcatggcccattagtgggttgtgaaatcaatctagagggttatgactggaaattttaaaaaaaggaatagaatttttaaaaatttcacagagtctcacactttttttttaaaacttttatttgggtggtatatgcaaaaatatttttggtgtgtctagagtgtatccaggcacaaccaataggcccaggtctgcatctgcctggatgactactgtcctctgcaaggcagatggctcggagcagaccagagctcatgatcccagcagtcatgctgatttcaaatcagagaatgaggctcagaagctgagacaaagcatcttatccctttctttcaaacctgcatattagacaaggcaatcttcttcatggattataggtaacaaagagaggacagagttttttgtgggaaagttcatatgataccaagaagaactaggaatatgcatttttctctaatagataatttatctttccctaatttttgatgattaaaagacgctagggcaaattcattgttaaaatttttatttttgtgtagattggcactaaaatggacttataatggcagttttgtgagttcagaaattcaacccaacatcactattctaaaacgttgggacgaaatttgcttccacggtgttatgatttgaatgtgtgtgtccctccaaaattcatatgttggaacttagatctcaagatgatggtgttaagaggtggggacttttaagaaggattaagtcacaagtgctctgccctcaggaatggattagtgattttataaaagaggttgaaggaaataccctcatgtcttagccttctgccttctgccttctgccatgtgagacacctcacatggcacctcttggaagcagacatcagccctcacaagactttgaatctggccagaagcagtggctcatgcctataatcccagcactttgggagatcaaggcgagtgaatcacttgaggtccagggttcgggaccagcctggccaacatggtgaaacctcatctctactaaaaaaatacaacaataacaaaaaattagctgggtgtggtggcacatgcatgtaatcctagctacttgggaagccaaggcaggagaatcacttgaacccaggaagcagaggttacagtgagccaagatcgtgccactgcactccagcctgggggacagagtgagactctgtctcaaaaaaaaaaaaaacccaaaaaaacattgaatctgttggcaccttggtcttggatttcccagcctctagaactgtgagaagtaaatttctgttctttataaaatacccagtcttcagtattttgttatagcagcaaaaacatactgagattcataaggaagtagtattttgtttaagagtaagcaatctacagcttgtacaactgttggctttcctgttgctaaagatattggtccaatcaccattttactgttctgagatcaaacaccataataagactcaaagaataaaaactgaacttagctattttaaaaataacttatggccaggtgctgtggctcatgcctataataccagcaatttgggaggctgagataggaggatcacttgagcccaggaaatttgagaccagcctgtgcaagatagagagaccccatctctacaaaaacaaaaacaacaaacttataattgtatactgtgacagcatttccatgtcaatagtaccaatttacaacataaacccaggttctaactgaggaaagtccaaaactctaacctcacagagccagtagggtactggagtgggggaaaggaatgaaaggacgtgagaactgattgactctagcaaatgatttccaattttataacctgtacatagctccaggattcttttttgactctttcttcttcttaaccccaaatgcaactggtttcctattgattctttctttgaaacatctcttaatttagtctcattctccctcttcatgacatcacggagcctaggcatgaattctcctgcgcttggatcatgcctccactttctgccttttccaagtagtccttcgtcagacccacaggccttcttttcaaggggctacttcaatgagattctttgccttgatcaaaatttctcaatgaatttcctttgcccacatctcaaactcctaattccaccttcaagatccttcacaagctttctcctttcaagactcacttccaacgtcttttcctgagatctccattacagtcaaacttagcatctctcaagcaaaccttgtcttttccttcctccaagcttttaaaagctgatatatatgctgcagctcctggaatacctccctggttgcaaccacggatacaccataaatcctgtctggtacaagggaggacatgcattcattcatttgttttaaagtgcctcctgttccttgtattctttctcctctacctcatgctttctctgttcatcatctctctctcaaccaggcttttaaactctttgaggtcagacagcatgtgttccttctttttaattctgcgcattttttttctaggatgtactttatatagataattttgatggatgatagtgcaaaaagaaagtcttttctggatattttcttggtgtaaatgaggtcaccctaatagcatctgtaatcactctgaagtccttcagcccatttagtctgaaaaatgttttcctaaaataaaagttctttcttttttttttttttttagtgcatatcatcgtcattcatctcacttttccttctaacatcaaggatctatacaaggccgttgatccccactgctgcatatttcttggatctatctgaggtcccagatcccattgcctcttcatcctcacagccactgctgggtctgggtcctcataagttctatctggaagtttcagtacagtctttctcgatgtgctccacactgttatgggaatgaattttcaaacacccctgctttgaagatagggtgcttccagggtaaggcataaagttctccagggaggcaacagtgcagtggtatacagacagcacagcctttcattcctgcgaggccacttacacctgagtgaggatgggaagaagagaagacaaggacgaatgtaggaaactgtcagttaaatgacaatgtatggatggcaagagagaaagaatagtcagtgatggaaaaataatcaataacagctttgggcttttgagtttgaaaatggtgtgtagggtgagacaacaataggaaacttctaataaagaatgaacaagtacttctacttgttcaatgaatgtgaatctggtacatacatttgatccttaaaatattctcactaaactggtatcatttaatggaactgtttaatgttatcctgggcaagttacttactcaatttgccttagcatctcatctgcaaaatgtggatgagtacctaccccccagggttatgtcaaaaattagataagatgaaaagtaagttatagtattagaatggcacccaatacatagtttggaattttttaaaatgtcagctattatgatgataacaatggtggcttacaagacctttgaccatctggcttccctctccaagcatgccaaattaatcacacttcttaaacacatctcttgaccggggtgttctcaccatgccctttctacaaacaaaaagtaagtactcttctcattctttagaaccaattctaaattctccctcatatgagaatttccttattattccacctggtatgaatgatttccacttccagggtccccaagactttaatatcatttctggagcatatgtgatgataatgtaataattataatgatactattatgctattgcatattatggtattcagtacaaacaatttcttgatgagaagaaaaatgcccattagaaaattaggcttattgttttgttttctcactataaaatatgctcattgtaaaaaaaagttaaaagaaataaaatcaactataatgtgatgttctaaagataatcaacctgatcatggatgcatttacctagggtattacgcgttttaaaacacattagtattgtgttccatgcacagttttcattttaggctttttttttttttaggcttttttggtacagttttgattctaggcttttttgtttgtttgttttttgggggatttttttttattgccttaagatgatatcatttaagggtatatatagtaatcattttgtgttagccacactatcaaagcccttctcagtcatgaaatctcaaatactctcctcttatcctcattccttccttccttcatttaaagaggaacttgaggatgttttctttcgtgaattaaaatttatttaaccattaaggtgtcaaatgttacattttcttttctgaaatggaacaattcattgtgctcacctaattggcatttcaaattttaccttgatgtcatttataaaagttctgcttcataggtttgacaatatttaaaatctgaaaaattaggtggctctggtgttgcctacacatgccaccttccaatcatcattctttattggtaagaataattagagtaatacagagattgaaaaaaaaatgtagcacatttgttcttggacataggacaaatatgcctggtaactagctgttaaaatggctacatttaatgtcaactgtgtcttcagcagagttgaactcaaatggaatcacacattttttgtttcctttaattattaacttcacttgggagtttagccatacctctgaggtgtcctttgttaagtgtattctcattctttattctggatgggaaaagaatagtatcaatatatatattttttaatttcatagaagggcattattcttgcccacatctaactagtttgtttttgggcttctggttcatcaaagaaagatgtggggtcataagagaaatcatgaaggttagttttatgaagaatccttcagagaaagagaaaaaatactaatattattaataacaaattatgaatggtactcttgtttgttgttgtttatgtgttttagcaacccacaggcctcagttgcacttttaattatctgggaatattttcctcttggctagctgaatggtaggaatgattgatgcaacactttctaatttcctagtgtacagctgaggcaaatgtaagagctgatgaaagaatatcccctctgtaggatctgctggattagaaaggccttcctgggacaaaataattatgcacacttatcttaaagttgccactatcataagtggaaggcataataatattatgttaagatatatttcctttttcagtcaatatggggacaaaggaacagaacagagatgaaagtttccctgtggcttttgcagttaactaaaagcccttaaatgactgtttatggcagtgatgttgttcatgctgcttggttaaggatctgaactttttttttttttcaaatgcttataacatttttagaaaaattaactcctgtctggaaattggcaaattataccttggtgtgagaatagataagttctgaggaaaaggaaagaaccagatatatatgggctttcagaagagtgaattctttttaaagaactttcttcgtgcaaggagaatttctccattaaaacaaaataggactaagcgttagaatttcagacttgcttttactaatcatgagataatatgaacagtaaaagttaaccagtgtttggatgttaggggccaaattgcattagtttatttgaggaaaatacttttacagtgattttactaactgacctttaattatttgcaaaaaggaagcatctagagatattttaaaagactagaggaaatagaaatgattaattcagggcatgacctttgctctggataacttgttttgttgtggttgtcttcctttctccctttctctctctctttctttctttccttttctccttccttccttctttccttccttctctctttctttctttccttccttccttcctttcttccctctctttctttcttcccttccttccttccttccttccttccttccttccttccttccttccttccttctttcctcattttgaagaaaagagtgcttggctgctcgttagtgggttatactccccctctttttcagggaggaccagggcaaaggaattatgatgtgtgccatattgtaaaaggaacatttgcttagaaatctgtagctgacatttttatgcaggatcctgtgcttccaaggcaatgaaaaactgaacaatgttttcctttagagtgtaaggaaaatttcagattaaaatggaccatacttactagtttccaataattttaattttatttatttatttatttatttatttatttatttatttatttattttggagacaggggtcttgctctgctgcccaggctggagtgcactggcgcactcatggctcactgcagcctcaacctcccaggctcaagcaatcttcctgcctcagcctccacagtagctggaactacaggtgcacgccaccacacccaactctggtttctgatttaaaatgacattttgggtttctttctcccatgaggtattagttggctacagttgtatgatttacattgctatagacctggagttcacactaaacacactctagggtttagaatacaggctttctcctttttctataatttttgtaaaacatttctggcattgttttagtaaaatatgaataagtggtaagttttttgagaattctgctaacttagttccattagctcatgactcacctgaaattgacatgctcatctttaatctagatgtttttaaattgtcttgttttctttcttgttcacgaaagaataatatttttcttgataaatccgactcttcatggacggatcttgtggaactgccctcatgtgttccactatcaatttttgcttctgccaacaaagggttctgtgggtaaatgctgctgtctttgcttctcctcatcctggcttgttgatgggtggacaagcaaagggcatggaaggatgaggccttcagctagggctcaatcctgcacatttgaagaatatctcttgaggttacgaacaatcatccaactggagtagttggggataaaattaaaatctcttctaaatagtttctaaacacaaattatttagaaatttctattcatttacaagttttaaaataatcaaaatggtacagatgctgacatgatcagtaattaccacattataaagaacaaatgaatgttataaaatgtgttttcatgttgttcaagtttttttgtgtgtgtgtaataaaaatttccattttcagctgggtgcagtggctcatgcctgtaatcccagcactttgggaggatgaggcaggcggatcacctgaggtcaggagttcaagaccagcctggctaacatggtgaaactaaactatttctactaaaaatacaaaaatacaaaaaatgagctgagcatggtggcgcatgcctgtaatcccagctacccgggaggttgaggcaggagaatcgcttgaacccaggaggcggaggctgcagggagcagagattgtgccattgaactccagcttgggcaacaagagcaaaattctgtctcaaacaaaacaaaacaaaacaaaaaatcccttccattttctttgtcacaaacatattaataccccaggtaataatagctccctcattgaatgttaactccctataagcagggattattattattttttgttcccttaagtgtctttaatacctaacaatcacttatttattcaaaaagcatttactgagaacttagtatgcaccaaacctaccaaacactggtaggtaagtctttagtacaatacgaatgaatcctgatttcaagggtatatagtttagcgggataaacagtcattaaacacattaccaaaagaacaaacaacaaacatacaagcattaagaaggaaaaaaaggtacaagagattctgagagacatggtaatttagtttgagggaatggtggtcagggaaggcttctctatggcattgacatttaagtgagactaagactagacgattattaacgattggttggagagaaacagcccagagtgtggtgagtagaagtgtagcacaggctgtggctggagaggtaaatgaggtaattcatccaacatgggataagaactggaatgtatcctaagtactgagaaacttcattaaagattcttaagcaaggaatgatccaagttgcattttaagaagatcatctggctgctgcgtggagaatgagtaggaaagcagcaagagtaaaatgggggagaaaaatcaaggggctatcacagtacttcaggcaagaaaactgttgacttatttccaagggcagcggcagtgaaaatgtgaaagatgagagtggatgggtgccatatgtttcggacgtctggttcacagatcttggtgatggtttaaacggaggagttaagcatgaaagaggtgtcaatgattgctataaggtttttaggtaaccaggtggattctagtgtcatttgtagagaaaagaaagactgaaatggagtaaatatggggcagataatcctcagataagttttagacatgttaaatttaggatgcatataagacatccaagcaatgttgtcaaatagacatacaagagctgtctggataggatctgtaaatttagacatccccagaatgtagatgatttctaaaaccagagggatgagtaagatggcctcgtgcagtgctttcaaacttgttggatcgtagggatccctgggcaattatttaaaatatacattcctaagctctacctgagacctactgagtaaaagtttccagggttgagaagtggcaatctgtattgtttcgttttgtttagtgaccggtatctcgttacgttgcttaggctggagtacagtggttattcacaggcacgatcataatgtgctacagtctcaaacttctgggctcaagtgacctttctgcctcaacttcccaaatatctgggactacaggtgcccattaccatgcccatctcaatctgtttttaataagcactctagttgctttgtatgatcagatacatttgagaaagattagaatatggaccgaatttgaaagaatgccagcatttaaaggtgtggggagaggaatggtgggggtgtggagaccaagaaggaggataagagcagaaagggaataacagaaattgtagggtctgaatcaaaactgatgcactctgcaagatgtctgtttgcatgaaacaaacaaacaaagaaactgacgctctgaaaccctctgatacagacttaacagacagcctcactaaacagctttatattcccacatttcatattacttttggagacattagtatctttattccatataaatttatacacatgagactttgccatacattttaccaaactaaaaggcattcaacagttagaattacttttgctatttctgtatttaaaatattgtctcccttaagtaaaacagtgccctgtgagccaaataaatacattttaaccaatttgagaggctagagataaaaaaattctagcctcataaatggaagcagccccagaactcttgcactgacatggcacttgaccattagaaagggataatttcaaatcataagcagcaagtaagacaaagctatgaagattgcacgtaggttgagacattattttctgcgaagtttagtattgtttttcaatttttgttgtggtttaccttatttgcagcagtcttattaggaaaacctaaaagagtctgatttaaatctcttgttcccagccaagcccaggtctgaaagggaagagaaaacacatttacattcagtgtcacagccttagaccccaagtgcaagttagactagatttgttgagatcaaaagcaatttctgtagttatttgtttgcagatttacagtttaaaggaaagaattaaatagtatgaacatatacactgcacttcccatgtccacatgtttgtttgaaattgcctgagtttattctataacgtttgatggttctattttctgccttcactatctagtgtttgttaagtgaaggtgggtttagctgatctgtgttatgtctgtgtgacatgtatcctccttcttttttggctttagtctcccttttgggtcttgacttctatcactattttggaaagccaggaagtcagccagaataaaatgaagtccaggagactttttttttatagcatttatttaggacagtaattccagtggcagcaagtccaccattagcaagaatatattggctacttttattatgtaggtctgaattccttgtctgtcataccacacgtaaacccagaagaaaatagttagcagatttatggtttgcactgtctctgagatgttactttgaatatctgattcataattctctggagggaaatcttacctcctggaagatcaagaggctgtgatggcattagaagtggagttgagcttctgtgccttgtgaagctcatttctccaaccatggaaggagtttgaactctcaaaaacatagccaagtatcctgcctttgtcattttgcctacttaaaatcaccaataaaggcaatgagtaaaaaaaaattgaaatttgaacttaacattgtatcgaaaaatctacctttgggccattcgtgatatagacatggactacttgattcagagacaggccaatgaggtttgcactgacaaaatctgaatataacgacatatagggttatgtcaccataagctttagggaggagctagttatccaaaggcatctggatttcatggcagcagctgaccctatttaaccttcagcattaatgactaacacttctcataagggctgttgtacctccatgcatttcatttacattgttcacctcgagaagaacatatgttattcctagaactcaaatggcatttgtttgatgagtggggtagcaaaagaggtaaaggaaaatactggagaacagaaagaaaagtcttgcattctaatattgaccttgtttggcttcctttgaattcctcaggaagtgatggaatggatggatgatgaagcggtgatggaaacagggctaaattaaattacaaaaatttggggtctagtcctgccactgatcacctctaaaacttagtttccatgtctataaaactgagatagtaacccctctcctacttattctacagggattgtgtaaagatcaagtgagatattttagaaaagaactataaaactcaaagattttatacaaattttaaagtatttttaccgagatagccaagtgaacaacacttcaaataaattaagaaattcaaatataaatagtagcagtagtagtgttgtagtagaaattgtagtagaagaattacggcagtagttgccatcgtttcttgaacatctaatatacagtaaaacctattctaagcgtcagaatccttatatacgtttctttaatagttataataactttgtaaagtagattttttaaaaaatccaatattataaatgaaaaaactaggtttcagagaaaagtgaaataatatgcccatggcccctcagcaagtaagtacagaatagtgtcaaatcccagtagatgcattttacatttatctgagaagaaaaaagggatgcggtttttaaccacttttcagtactttgtttttcttcctacttggggttgttattattacattcctaatttcatacttccaccttttgcattaggatccaagagaatacacacacagactggacccccacttctctctaatttttttgacattagcatgactgggaaagactctttgaaactgccaagatctttacgaacagctgagcctataaagtatacagaatactagtaataagcctattatatatgttgtgtgcttctgtaagtttccaaaatagccttattgaaaatgcttctacctatgttaaatgcattagtgaggccaatgtcagaggaaaataataagatgactttataaaatgttaccaactggaaaacatcagtgaatttgtaagatcttccttctctcccagtgaatggaactgaaataaatcctaaaatgactaaaactttgaaagatcaagctcgttattacaaatataaaaaaagtaataagcatacttaaataaggatgcagcctctttcagaacattaaaaccatgttcttaaaaaactatgaatatatataatggaaaaataccctgtataatcaattatgatatctattgtaagatattactaagagaaaaaaattattaaaacatcaattcaacaaagagtaaatttaaagaaattactcatttcaataaaaataaagatcactatcaaggcaattcatagaaaaacttcaaacagcccataaacaaataaaaaaaaagaacttacaatctgctatctaaacattcaaattaaaaagatgaaatattttacctgccacaatgacaaaagcttaaacaatttaaatttgataaggctttctttctgttactggcagtcatacaggctgctgttcggaggacaggcgatgtaatctttatgaaaagatacttgaaaatattatcaagtaacttcaaaactttcagatttttcagccagtaattctatttctaagcaaatagtcagagttgaagcatagattaagtataaatacattttattgttattttcattgtcaaaagttagaaaaacacagttcaaaaatagagaaatattttaggagtatactttcacatggcattaaataacatatttttaatatcatataatataatggcttatatttgggtaggaaaaacaaatctaaatgtacatacaaagtatacacataatttcgtttgaaatcatacagcagaggaaaaaatactagaaaaatttaccccaaatttgagtggagacataaaatttagtttttctttataagcttttgcatgtcacagttttatacaatgagcatgtagtaaaaagttcacataaaattgttcataggaatattaaataaagttcgaacgaatcgagtgacgctgaacaataaacctattttgactgctaattgctaaagtaagtaattaactcaataggacatcatttcatttataagaataaattataatctgtaaaaggaattttgcatgacatttgatttggttttaaacggaccctgagattgttaaacgtcaaattcttccattgtttaaaatgaatattatattacaactgcttttgcttcctggaagtggaatttacactttttcttaacgctattgttatattttctcagttgcctaaataatctatgctcagagacataatattttgggaattcatattgcttgtttctttctttgtagttgctttaaaagtaaatcctttaggagaacatttctttagcttactttttcattatttccagaggcaaaaactggcagggcaatttataattcaatttttgctaaatccatgacacccaatatatatgtcaggcatttcaacggcagggtactttggggaaaggtgataaattgtactgattataagctcaagctgttcttctaaaacatcatatcaaaaagaaggtaagtattattaggaaaatgtaatgtatctttagattgtccagaactatcagagataatcacttcatgtgaatatatttcccttagtgctatacagcaatataataaggttcttactgtgtttttgatagcactcatctggagaaaggtaaaaaaagaccctatcagttcacaaacctatcacaggctggtagtctttcagcagccacagagctcttagtgctgcaataactcactcctgccagaaatgcctcactctgaaacccaaaacatggccctaatcattttaggactatgttggtatatgtgagtagtataaatattattttataatataatctcctctgatctttttaaacatcctttcagtgttccaggtatttccctgtgtgatatgtgtggcttaagcaaagccacaaattccctaggttatctccaaaaattgctgagaaagtggacaattgaaatataaaactctgctctggtgggatacaggcatctgtgtgtgcatgtgcgtgtgtgtgtgtttcacacacacatgctgcagtttagtgtggcattccattaatgagtgaagtaattaagcaaagcacatgggtaggttactcagatctaagaatagggaacgggggattggagcctttcacctccaggtcaatggtttctgtttaatcgggctgttaatgaccaaaagtcattgtttccatctgagagctgtttggtctcaatatgaagtaagttggtggtctgctctcagtttctcatgtgcaattgtatggatcgtgaaatctatggcggctttttgccaccctgttggacaactcagtaaaaaacatgctgtttgaaggtaatggcaaaacaactctgtctcagacaaagtgtacctccaaaagaaatgtatttctaaatagcaaaaatacattgaaattgttgacatgaaataatagaagattcatgaatttgcttttactgtgtatagtaggctttatatttacatagttacttttacatacaataatttgtttgaacctcagagttaatgagtgtgatgtaggccatgctgataataatatttaaagtttcagaaatcaaagatcaacgaggtcagggcttgcctaagattatggaagtagtaagttcctacagcagtgctagggcactatggcaagccttttggaagagtgatttgagcagggcttctaagtaccagaagaacttggatagagcagaaaagtaaatgatattccatgaaggacatcagcatgaggaaagtacaaaggtagaaatgagcagtgtgtgttcataataaaatatattacatacattttgcagtatgtcttcacacaagaatacacaagaaaaatcttaaaaagattttaccttatacacacagttacatttatgaacacctgtatgttcacacagattaaggttacattaaaaataatgaattggtattggtgttctttcaacaggaacagtagcattaaagatgtattaagagcaaaacatgtaaatatttatgaggaagcagatgtgaaagtgctgctggaaacaggcaagaagtatcaaaacttttttgtgagatatgagcagtggctgaaagataaaggctctcagtaatctaacagtaaactaataatacgtcttgattaggaaagaaaggcttctgataacctccacctctaaaaaacttttcagtcaagaaaattccaaaactctctgcggcatcctgctactgttgtcacagcaaacccaggtattagcttttctcaactaggagctggactctcccatgtgcagactttagaaaatggggataatttttggctttcacaatgacaagggccactaatggacaaggtcagagatgctcggcaccagtccctcactctgaaccctgtcctgtccccaaggccagtagcattcccccaacaagagatactgttaacatttttctcaccactgtgtctccatatacccaagactataattctaagaccgacaaatcctagatgaaaaaaaatcacaattcactatttcaacatttttatctttatttctcaactacttaaattttgtctccacctttaaaaataatattcctgctaagattataactaaactgaatgtctacactaatgaatacttttcagttatctttattagacacttcctctttctggaaactctattctgtcttgacttcctcaatatcattctctccaacttttcagagcactcctaagtcatctctctaagtttctctgacttctctaatccttttatactaatgttctttagcgtccaattcttagctcccttttcttaaattttttccccacactcatggcctcggctatcaccgctaatgattcttaaatctctatctccagcattaatcaatctcttgaaaacaaacctcggtgatgtgctgcgtatctcaccttcatatcatataggcatctcgaactcagatgtgggcttgtaaaaggctcaaaattataccactgcactcttgccctttctgtcttcattcaaatgacaagtttctattaagtggagctaaaaagaaaagtagagcatggaatctgccttttagcttacatttgaagagatgaacttaattacaaaaagaggcgtttataattctataggagatagaagaggaaggactgaattctagaaggggaaatggagagagggcacgtagtagagtccaggaaacatctaagggtaaaggacatttaagctaggagtttcccagatgattagagccattctgaacaaaagaagtaatgtgtgcatgtagttgagaaagattagggtaaattcttgtacctcttgataatttggtgtgactttgcagtgcacaggaagaaggaaagtgcaatgagagagaggcagccaccagatcgtaaaggtgttttatttccatccaaaataatctggaccttatactttggacaacttgacaattaactaagtttaattagagggtgcaggacaacatcagttttgtttttcagattattctcagtatggtaaagaggatgatcggggagatggagcattacacaatgaagacaaggacagcgtaggagaatgtgttagcagccagtttagcgatcatgaaactctgatttaggatgctagaattggaacacagaggaagaactgaagtacatatatactattttttgaaagtgaaatcaacagattcggtaaccactgaacctggaaggtgatggaaagggtagagtgttgagggtgaccaccaaatgtccaggttagatggtgtaaggcagaagccattgaaaattatggagaatataggaggatagaaatgttttggggaaataaaatgagcaaatatcatggacttaaaaaaagtcaccttggaaatcaaagctgaactagggcctctttttttctagaatctgaactataccaacccttttccttcttaggacaataagttttgggtttatccttattggtagaacaggtacattaaagacagagaaagggcattggaaaatatttcaaaattatcattcttattgacttcaaatgtaatatgtaatattaggtatgttacttaacctttcagtttcattgtcttatttgctaaaagagcaaaaagatacctacctcacagtgattctgagaaggtaaaataaaatggtgcattttaaagcacagaggcaatattttttcacttagaagtctctttaaaaattatgttcctcttttccttctcacactgtggttttcaaatagcttacgaaatacgccaagtgactggtcacagtggctcataccagtaatcccagcactttgggaggccgaggcagaaggatcgcttgagcccagaagtttgaggttgcagtgagttacaattgcaccactgcattccagcctgggcaacagagtgagttcctgtctcaatgagagaccatccccttataattatatatgtatatataaaaaacaccactatatatatatgtatatatatataaccatatatatgtatgtatgtgtgtatatatattgagagagacagagatccacatatgtatgtacacacacacacacacacatatatgcatatatatatatatggtgtggtggggtcttgcactgagatctctgtctatgtatatatatgtgtgtgtgtatgtgccaaatgttccccagacatgtctcctatctttaaaataaaatcatgctccttataactcctatattttagcaactctcacagagaataaataatttactggcattgtttttctgagcttgcttggtatattcagagattcagcaatcaagacttaccttactgggatgatttgtgtcaactagattttttttaaaagatagtacttacagaaaactaaacaccctttaaagaacaagcattaagagtctaaaccattttaatgaaagctcacatacataagaggtgaataactgtagcagttggaatttgaaaatgaggttttccttactttgaggatagagtcgtgagaggtggaatggcaagagcagagatggccaaatcctgacttgatatttggtaggtccaactgatgaaatactttaaaattgatgcctagcagtagaatttgatgcaacagagtcccaggaaacctgacaacaaagaaatgatcatttataaaaagcaagattgaggaaaattttggtataagataaacagctctaatgagttaaattgctctagaattattccagccattgggccccttatatgatttacacaaaatttggtttagttgatgtggttgtttgagtgatttatgctactgataatgaaagcttataaatttctctaagggaagtatagatctttgtagtagactgttttagttcacttacagagttcacttccactagcagcaacttaagccttttatataaattggaagagcctgccctttccaaactctttcatgtacccttgatcagccattgcaaacatgccaggatgaaacacaactggcagaactttggatctaaaccactgtccccatctaatgttatctaatgtgctcaaagggcctccaagaaaatggaatttttcagcagttgctttcaactaaatgtttatagcaacatgaaaaatagaggagaaaaagatcatgttcctgcataaaatgaaatacattagagacataaatattgatgagattttatacaggcataaaagcaggtgaaatgattgacagaggaaagacataatgagacaagaaggggcctgaatggcccgaattcaggaccctgtgtgaattcacaattcaaaaacagaatagaggatgatgagttatcaatgttaactgaagccaagaaagaagaatgtttggttttgaagaggagatgacaagctgtgttgaggagaagtgggatgaggagtattttagaacttgaacatatttaaatgctgatgggaaggatgtggtagacatgacatggaaaaggaaagaaggaaagtggaatcccaaagcggtctgctttatttgggttatatacatatatatcaatacttaccatatgagaattcataattcagcaattattaaaataagtatttattattttaaaattagccataataaatttgttacacataaataacatatttttattttaaaaactgtattttccaaagtaaaaataaatgagtgataagaatggcactgttgtacatattttcaaatctccttaatgttatgcttaataaaagagagctggattctcatacctgcctcttcattcagtctgttgccatatgttgctttggttaatgtatatgaagaaaatctggccttacacagatacatagtaggacaatggagaaggtgtcagtatgcttcttggatactacattaaaattcaccacgtggtagtttaatgaagattagctgcaatgtggaatctgtaatgatatcaatgaatattttgtattctaaaatcaatttgtctgtcttgtgctttgaatcaagttatgtagctcttctaaatgctaacattttatcatacaatgtcaaaaaattacacttaataatatcactgatctcatcagaaacttttttttttttgagatagagtctcactctgttgctcaggctggagtgcagtggcatgatctcagctcactgcaacctccgcctcccaggttcaagtgattctcctgcctcagcctcccaagcagctgggactacaggcgcacgccaccacgtctggctaatttttgtatttttagtagaaacggggttttactatgttggccagactggtctccaactcctaagcttgtgatccacctacgtcagactcccaaagtgagaaacatccttaagtaccgggaagctgtcaagtttatgtcaagtttgggcaagaagcaacttgcccaaaattccagtattcacttgaaagcctctatatcattggcaaaaaatagtttcaattgttttccttgaagtgataatttcactccattcattttcaacaaaatgtctgccagatacctaagcctgaataagtcaatttttcaagtaaaataatatttaataaaaaagctctcaattcaaacaatcacattttttctcaagaagactataattctccaccatgcagtagaagtgttttatgtgtgcttcctattgtgtcacacagcatatcaaaaagatgtgtactcaaggttcgaggtttaatacaattaataatttctactgccttacttaagtcattcataggtgaaactacctttatatttaaaagtgcaagtgtgtggaaatgaacaacataatgaccattagctcagatggtcagacctccttgatttgtgctaaggcatccacagtttgacacccatcagtgcaaatgtcaagacagtgaaaaggtcaaacaatactttagtattatcataaaaataattttgaccttgcggaacccatgaaaatttctaaggaacccccagggtccatggaatacactttgagaactgctactctaagaatttactatgcaataaaggtggaatttaaatcagtctgaaaacattttctgaataaatatttctaggattactggaaagctatttggaagaaaaaaattttatttgtaccgaattttatgcaaatacattttaatagattaaatagtacatgtttatggtcttattatgtaatactcttagcaaatataggtagatatatatttaatttagggatgagtaagatttttctctgcattatctcaaaagaacaatccatagaaggaaatatggatagatttttctacaacaaattggaacttttaaaaaatatcaaacaacttcagtgtctagagaaatagaaacaaaatggaaaactgagaaaacactaactgcaacatgcaaaaaagataaagaattgtgtccttcatacataaggagctcttgtgaattaataagaggaaatgaaaatatgatgacagataattctcagcaaaagaactacaggtgaccattgaacaaatgaaaaccacattcaacctttgtattaggtaaaaggcattcaaatgaaaattagtgaggatgggaaaaatggttgtttcttatctatttctgtttaacagctcaccctaattcttagcagcttacaacaaactctttctgacagtgatgggtatgaggaatctggggacggcttagttgggtggttctggctcaaggcttctcgtgaagttgcggtcatctcaaggttggactggagttgcaagtttgtcttcaagctcatgtacacggttgttggcaagtctgagttcctctgggttgttaggctggggacttcagctcctggcgatgagttgtccaccttttcagtgggctgccaacaacgcagcactgtgcttcccccagctcaagtgatttgagaaagagacaagcagcacataagacagaagcagtctttttattactgaaatctgatgccatagcccatcatttctgccatattctgttcactagaagcaaatcactatgtgcagcccaccctggagaggagagaatcattgcggaccatcttaaaggctgcctaacaataagaacctccaacatggcagacagcaatgaaacaggggggagaaggtattgtttctagttgtctggagggcaatttggcaacatatgcaaaacgtttaacatctccttggtccttgcggcatagcaatgttacctctaagaaataatgaaggccgggcgcagtggctcacgcctgtaatcccagcactttgggaggccgaggcgggcggatcacgaggtcaggagattgggactatcctggctaacacggtgaaaccccgtctctactaaaaaatacaaaatattagctgggcgtggtggtgggcacccgtagtcccagctactcgggaggctgaggcaggagaaaggcgtgaacccaggaggtggagcttgcagtgagccgagatcacactaccgcactccagcctgggcgacagagcgagactctgtctcaaaaaaaaaaaaaagaaagaaagaaataatgaatataaggcatgtgtaaaagatattaccagcagcataaactgtaatagtgaaaatttaggggaaacctaaacgcctagtatgtaagataattaaataaattattgcacattccaggaatacaaaatttgtaactgtcaaacatatttttgaacaacttttaataacaagggcaattaattgtaattgatagtttttgaggggatgtatatgttatatgatgatacattttgtaaaacttaatgcatgcacatatgcattgaaaccaattttggaaggatagaatcctaaatgttgacagtgatttcttatgcatggcagtgttgtgggaactttttgttttcatttcaatctttttctttattttctaattttcctatgctgagcctatattacacaaacagaaactatacccaagaaaagaactataaaaatacataaataatgaatcaattttttaagaaatcaacagaaaatgaactttgatagaaatgatgttgagactatctgccaaaatattatataaaatataataattttaaaactgttatgattctttttctatactcagtctgagaaagcatgagctgaatggcattattgtcctaagtatgcaattataaatgaaatttgggctaaggggagtgggaggtggttgcaagaaaggatgtcaatagtctaacttttgttattaaaaaataaatcattatttcttcttggattcctaaaaagcagacaaatcataggttccttggtagaggattacccttttcagcagaacatgaattaagtgatttaaggggttgcttctggtctaaatatagtggctttgaccaatttaattggaattctatgcagtacttttatttgtaagaaaggacgttagttcaggatatgtggaggttgtttaaattcaatctctcaagccactctgagtgtctctccttctgtcaatggcagtgctacacggggcccaagtgcagcatgcctcttggtgactctcacagtactttctaaaagctctttataatattttattgctgagtacctccatttataaaggaggaattttgaaatagaagatatttttaagaccatctaatatcatataagaataagttgattcagatttgaatttattagcttcaaggaaccaaaaactgaaaaaggaatagaagcagacgaatacattctttagcagggactgtgaaaagccccttaagaagttccattatagcatgctcttgtatgatacaaagtttaggtttcatctggcattccacaattgccctgttatgatggcttttagtagctgccctactgtaatgtatctttggagagtgtttattatattttaaaatttggatctgaatccatctccaaactaaatgctgacattcacaagggcctgattggctctctctcagtctggagaaagctcttattgtggtcaactcaactgagccaactattagcaatgtcagaaccgttctgcaaagcagggcaatacttagttaaagtgattcatattagctgagcatgagcaaagaaatctgaacaggctgtttcagagtcctggactgccaatgaatccattgcttttgtgaacacagtgggaaaaaaaatcagggttcatgctcctaaggctgttcagacttcttagtaaacgtttcactgtgtcccaaggagaagacagagtgttttaatgtggggaatggaaccttttgtgctgtctgttctggagaaaagaatgtggtttctaaaatattactttttgaacttcctgtactgtatttatacaattctgtctctttaaaaggctaaattgtgttatgactaaactagtcactgatagacccaacttgctctgtgagagaagcgttctttaacatatcagagccgtttcctttgtgtggtgcattccttcccgagtctgtcactcagcaagagccgtaggagccatttgtccactgaccaggcaacacaatttttgttccacctgcgaacgtgtttatgggttagtggtgaaaagcttgggcatggagtgagacaaaactggaatctagccctggctttgagttcacttccctgagactcagtttcctcattgtaacataaagagaataagcaatacctcttgaggcagttgtgaagaatagagtgtgtggatagcataatgtctcataattggtaatggctcaaaaaattataatatgagatcagacagtcagaatattttctttcatttggaaaatatgctcagttgattaaaatgcttcagtgaatttttgaacattggcgtatgtttaaggccatctccatatatgttttgtgaactcagaaaaagatatcagtgagaatagaaagaacagataatgcaatatttccctttaaaaaacaaaacaaaacagtaacccctagaacgaaatacattttacattgtgacctagtctgcaatacatatataggccatatgtataactgaaatgaaaattgaaagaaacctttcttctatgtgtgagatactctgatactttatcttctcttcccttcccttctggtcagaatcagctacgctgattttacacccactaatagtgtataaagaacaacttgaaaaagatattgactcaaatgagagtaaatgaatttattacacaaatttgtttcacatcagctattaagtcttattttactttgatatttcataatttttaattccattaatgaatgcctcagggaaaggtgaaagaaactaacaattcataagtatacactgtgtgtcagatattacctatgctgttctacatatatctcctcttttaacagtcacaataatcctactgttaccccattttacagataaagaaatgaaagttgaaagacataaagtatcttacccaagaattcaatcccatctattttttattgtccctgagtacaagaggctaaataagcataaacatcgataacactgacatgtctgttagcttttacctctgggctgttgtaccaaatagtcatccctttaaactaaattatgcatttttgaccacttcagaatagaatttgagtttaaattacaactcaaaaataggttggggaagatcacatattaattctacagaattaatgaaacagaactccctgttatgtgactattttattctgtgagtctaatagttttttttaatttacccttaaaatacttttaaaaaatacagtacaggaacctatattctcttttagttaaaaataaaccaaactttgatagtacagttataaacctagaagaattttagtttgattccagtgtttgaaagcatgatcaaactccaagtttattttttcatagtttttttttctcctacagattcttctccacaatggattaaccacagacatttgaagtcatactgtttaaatatctttgaattatttttgtttaaaaatgtcaatgggtacgataggaaaagtacatttttttccctgtaacttcaaaacaactgaacagaacctttggacttaaaccaagaattgaatgttttagctttaagaagattttcttctctgaaaagtaatgaatgagtctctttgcaagtttaactatttcaagtatcaactctctgactttcagcattctttggtattaaaaaaatgtttcatgtataaataaacgtaagttttttttctcagctatctctcaaatctcaagttacataaacttcaaatacacataaaacgttgatacagatgaattgcataatgtttttaaatgtttaaaatgtagtgttccattttgttaatggcttctttcaagtttgcattagtgaatgacaacccttaagaatagcctgcaatgaccagaggaatgggaaggatgtcattttctacttgctctccatggaaactgagaagagatccattactgtgatacccttgggggagcagagacgtgtccaggaactttaagtgtagtagattaccaaaaaatcacgtacaggctgtgggaaacactggaggttgactgagatccagagtttctcaacttagtgttggggcagttgacacctggggtctccattcagatcctgagaggaatatgaggcagacagatccatgtgtgctctccgttttgggtgtcagatctcacaggggtttcccaggggctgtgctgtggctcccaggacacaaggcttcccaaactatagaggctgtcactgagagcagcacaagtcactaaggtacacacaactccttgggccacagtgcctgggaggaagacttctcaaatttcatttgtgaaaaacatgaactaggggaggatgtaaaatttgtaaatgcagattttaaatggaaatgactttataaaatcattcttaaaatttgtaagtatatactggctcactttttttttcgaactgtctcttttttgatatagtcaatatctgtagttgttatgtaagaacacaatacatttcttttgtatttccattcaaaactagttatatctacaagacaaatggactccttttttgtgaaggaaatttgtagagataagatgaagggtaactatcactaagagttaaatggtgactaagttgataggtgaaggttatcagaaggaaaatatagaatgatggaaggaatcactttgttttcttattttctgaagcactctttgaactctctgataaaaccaaatttgtgacaaagtgccaaaatctaaaaaaaaataataatatcaacttggtggggaaggaaatatattttacttatgtattttattatctcctaagtgatttagtcagtatgtgtaataaagtgagatgaaaataacatattctttcaatataaaagctttttatttttattgctcaaaattgactattgtatgattacatagaaataaagaagcagcctgcagaggattgtactttaggagtgctaatctggcatcacctgtgctaagaaaggagagggactgggagtggaaaaaggcattttatttttagtgataaacattgtgtttctaaaaattagatattcagccttaaatgtattataagaagatagttatatggtagagtgaaaagacaataggagataaggaaagacatcagagttctagcttgaatttttactctctaattagaatgttgcagtcactatcccatgctgaaatttagctttatgatctataaaataaaaattatgccagctttgtctttttatgctctaaaacaatttggggaacaaaatcactatttcatcaaaaacaaagaactttaggacttagataaagttgccttttgtgctacccagcgtcagggctcccttctacagtggaggagtgtgaagcagcagctggtaagcaggccccgtgcatagtatgagcccacccagctcatcgactttccctttcttcttcctctctctgaactctgcttcagccattctctgctggtgactgtgccatgaaaataccacgctctcttccttctctgggttgtttttctctttccccactaatctctatattcctgctctaactactgtccccattcttggcgtaattttttattcttcagctctcagtttaatcttgcgaaggtacataaaacatctagagtcagagcacctaggttcaaattctatcaatcactttaaataacaggtagcttggggcaagctattaagtctgttttttcattggtaaagtgggaacgaggacctactccttagggattgctaagaggtttaaatgagatgttacatgtacaatgctggctctgtgcctgccatatagcaaacacttttttttttttaaagagatagggtctcgctctgttgcccaggctagagtggtgggggtattcacaggagtgaccatggctcactacaacctccaactcttaggctcaagagatcctccctcttcagcttcccaagtagctgggactacaagcgcacaccacagtgcctggcagcaaacactcttaaagtgctgaacagtattataaatcgcagagctgtctgtgtctccctgaatgatagcatctatctccttgttttggaagtgcgtatttaggccgttgtcttcttacatacacccactgttgtccccacatcccaattacaccacacagttcccgagagtagaaactgagtctcctttactgctatatcctcaatgcctaaaaattagcctgtttcatggttgaggcccaatgaatatagaatgaatacatagttattccacttcacaatctaataagggaaagaatcagacagcaattctaatccagagataaaatctatagtcaacaaaaatgatttagggatttgctttttagcaccctggaactgttggcacattttaaagtatttattttaatattttggtcatttgaggcatatgactaagcaggtttgaattccctcaccagggaactatgctctttgatgatttgttctttggagacctaattctgtgcaactgtatattgataaaataagctaacaatatggccaggtattctttattttggatctcattgatgaaggtaacataagttgataatcagattttccttttgctaaaatagccaagaaaatattttgttaggctgggcacagtggctcacgcctgtaatcccagcactttgggaggctaaggcgggccgaggtcaggagatagagaccacagtgaaaccccgtctctactaaaaatgcaaaaaattagccgggcgtggtggcgggcgcctgtagtcccagctactcgggaggctgaggcaggagaatggcgtgaacccgggaggcggagcttgcagtgagccgagatcgcgccactgcactccagcctgggtgacaaagcgagactccatctcaaaaaaaaaaaaaaaaaaaaaaaaaaaaaaagaaaatattctattatttgctttctaaagtctcacaaacaatttaggagcaagaaagcaacatgtgggaaattccataataaaacataaatattttttctttacaaaaatgacagatgcttatagcgattcatatctggggcaccaaggttttcaactgaatgtaactattctcattttatgaagaaccaaaaggaaaaaagagtgatttgtttgctcactgggactttaatcccaggtttcttgtctcccattatcttctttatactgtacacttttgcccaagcctgctgtcctcctgtactgcccacgggctaatctcatcatatcccctaggtcctacaagagttggagccatcctctcctcatcttctactttctgccttcttctgggacacgctattgatcacgaagtatcttatccttgaaaaatctcctctcttcaactcgagtactactgcagaaagcagcaacttggcggccttttatggatgggtgttactgaagttaggacaaatctataataagttcatttcctctaagatgtctacccagaaggacaatacttaattgggcacatatactctattggatctatatgctcatgactttataagtaggcattctgcatgtatgtgcaaaacaaaatagaacttaggaggataaagcatcctgtaaaatgtgggacttaagactgtatcagggaaaggagaagaaaagaaaaatataaaatctgatttttaaaattatgactactggagtgtgcagaggttttcaaatgacttgttggtgaattgtaaacctataaaatgtgtgaagccattttataaagaaaagcaatgtttataattttttacccatataatgatttaaaaatagaagagatcaccacctaccctgattctttaaacaagcatttgcttgcttcagtgattgtgggttagctagatgatcttggagttctttctgtgatttagtcagtgatattgaacaggctctacagcaaggaaagaaggggaactgtataaagtaaataaacttaacaaagcagaagatacatgtacccagagagttcaacaatttagaatatttgcctgatttttttaaagtccaaaagtaatctgtattgattataacaggaagctacttttccaagttagaaaatgtacgtgtgtggtcaaagccgtctttaaaacaaatgcattgaaaaatttaaaaggtcctttgtgtaaatcacaagtccctatattgtatcttcattaagtctctgaaaatattttagtcaatttatacagtcctttaaagaaggtagtatgtgcaaaaatatgcactgatacctaactacaaaattattttgcacatcacaaattgtatacatgattgtcatggatgaaacatgctaacaatctttattttatttatttttattagttattaatttattaacaatttttaatttgtttgtttttattattttatgccttcattcatgaagataacatacattagtaaccagtttttcatttggctaggctgttcaagaaaataccctgttctccgttttctaaatgctatgaaagtcacaaagtaattaattaaaagacctcagtatcatgacaacaccatcatccttctggtcaacacatttcagtgatgcagagtgtattgtgacagcctgcagatgacacaaaacaatctacattatcatcaaatttcatgtctatactaataataatttttcactgaatgtagcaacaccttttctggctggggttgggctgaggacagaagtgctgttgagagagaaaaaaagggagaaaaaagaatgcaagctggcaactagttaatgaaaatcataatgatatcagtctttttgcactggaaatatgcactccatcgtgctcaaatggtggggagtgcagatctctgataagactaggggactgtggtcggggttaggtcgaaggcataaaatgccttcgcacacatgaatgcttaccatgtgtgaccaagtgggaggaaactgtggtgagacagggaaggagagaaataactcacttagtgtctggcatgatgatgttgaatctcttcagtaatgatttctgtgttgtgtgtgggttatgggagtttgatgttgctttatgcctgatgcaaagaaatgccttttggctcagattaggttgtgatcacttcagtttggcacctagttaccagtgtcagcatttacagttcattcccagccatgggtgcagtaagtctctgagatctcaaaagctgtaggatgcaacccacattgccttctggccttcgaggaccatgccaaattccttaaagcaatgacagctaagggtcataaggcggcactgattctacctatgacccagtttattacactatgtcagtagcagctcttgcaaattaattttgctcattacagcagaaaatgaatcaggaagacagaataggacaaaatgcttccaccaaaattttataaggtatttaaatcagaggaagggaaaaatccctggctttttcccagacacgaaagagaaagaaaggaggcagctgaggtagaaattctcatacattatgcagattattatgattaaaacctcctaagtaaactgtgctgctgaatatcctttagattttgtttttgcaaaatccccaatgctttggaaatatgaaaattccaactactagcctatgaaaccctagagaacctgcagaccagaaaaggaaacctggcataataagaataaacaatgattctgcttaagttggatgtgaattgtcaaaagaaaagtccaaggcagacaaatttcagtctctccagacccttttcaaaccttttcttctgacagccccatagagatttctgaggtctttcttgagcaggtctggcagctgagccctcttcgtcaggagttctcaatggcccccaaggtgcctttgtttcctcaaggggttttcatagcatcctcagctgtggtaagaataattagaatttctctttaaaacctataaaagtccaaattacatgtcttttaaacatttttctgttgctttcctttattttatgcttctgttcttgtttttaaggaaggcaatgtatcgcatcctgtattaccttcccctgacctcatagcttcccaaaacaggaacaatcatgggctttgaaggtaggccacgttggtgtcaccagtttctatggccctcagcaagtcatttaatctttccaggcttccattttctcctttgcaagatatggattttcttactgtgtggttatgtaatgaatgaattatgtaatgcctaatagatattaattattaatttttttaaaacaatcttgttctcgtaaagaagttaggaactgggagaagcaatttttaaaaaatctacagaattgtttgccacaagccatatttgtcaccaatataacaattttaagattagatgaaagagatactttgaatctgagtcttctcatcggtctaccccaattaaaacagactttctcagctttggacatttcccaagatgcacttgcaattcacatttcaattctgtatttataggtgaaagatattaatcacataaaaaaaataatctctttattatcctgccttcttgccctctattaacacgcgtgctgtttttgtttcccaaaaggaagtatctctccaagccaaaacgttactggccttggttaatattctttttaaatgatacctttcattcagtaactccaaattaactcttcattcacaacccacagtttgtgattatttgcactactggattatttaatcttttatatttttctctagtcactttatgtttttaatctgacctgtgagttctaggacttgaaccaagggttccgatgaaaactctttctgaaaccaatgttttgctgctgtggtcattgtttcttggcctaaagtagagtgcttattacagtgaaaattgggaagggcagtggggaggagggataaaaaggcatagttaatgagtacaaaaatacagttagatagaaggaataagaggtagtgttcaatagcaccacagggtgactataattaggaaaaacttacagatttttaaattatttttatttatttatttatttatttattacagagtctcactctgttgcccaggctggagtgtggtggcacaatctcggctcactgctacctctgcctcccgggttcaagcaattctgctacctctgcctcccgggttcaagaaattctcctgcctcagcctcccaagtagctaggattgcaggcatgcaccaccatgcccgactaatttttgtatttttaatagagacagggtttcaccatgttggccagggtggtcttgaactcctgaccttaagtgatctgcccgcctcaacctcccaaagtgctgggattacaggcgtgagccaccgcgacctgcctgaatttttcaaaataactaaaagtgtagaattggattcttcctaacacaaataaatgataaatgcttgaggtgatggatatcccaattacccttacacattgtatgcttgtttcaaaatatcacatacacaactattatgtatccatagcaattaaaaattaaaaaaaaaacttcaccaccatgattccttggttccttgaaataaacatgactcaagtttctttgaatagttattttaatcccagttctctactactgtggtctccaaagtgcaatgcacaaaacaatccattggaggacaataatatttgaacttctttctgtacttattttttaatctaaaaaaggaaagccagttgcagtggctcacacctgtaatctcagaactttgtgaggctgaggcagaaggattgtttgaggccaggagtttgaggccagcctgggcaatatagcaagaccccatctctaaaatatcaaaataaaaaaaattagccaggcatggtggcacatgcctataatcctagtactttgtgagacagaggcagaaggatcgcttgagcccagaagttcaagaccagcctgggcaacaatagtgagacctctatctctgaaaaaaaaaaaaaagggggtgtgtacctgtagttcaagctactcaggaggctgaggtgaaaggattgattgaggctgggagatcgaggctgcagtgagccaaggtcatgccattgcactccagactgggtgacagaatgcgatcctatcactaaaaaaaagaaagaaaaagaaatgacttaacttataaaaagacaacgttcttagtttgtttttaaaattatctctacatctatggttacttctagacttgtatactttacctattttctttggctcatagttattcattgattaatcacactatatgaacagttcacatgtggtaatttatgaccacaaatccatgacattgaaattatgtgctccattaaattcaatccacatttattcaattctacctactttgagttctatatcagaatacttatgagaggtgcaaacaagtccttgtatttaaggaatttgtacttactataattttgtaagctttaagttatatacgtatatatgtattttatttttgacatgaggtttctttttggaaatagatataaaataatataattagaatccagtttgaaagtctagaaacatccttccaaaaccatagacaattttttctaatgaaaatattatatcgatacaagtaaagaatgaagatgtggagacctggagacaggtggcacctcgtgcttcctccgaagggagagcccatttcctaacagctggatcaaaggcatgaaatgaacatggagtccctgaagatgaagagaaggcatggcttccagggagaaattgtacagttagtgtcactccagggtcccaaatagtagaaactatttcctgtattctagttgagaaattgtttccctgattaagaagacatcatacttcctaagagaagctgctattaccatgacatccaagtctttatctagcagttcagtctttcacctttctcttcaccctccacctccaaacacacacacacacacacacacacacacacacacacacagagctccctccactgaggcatctggcacaactaatcatcttcaatttctttgattcacaaaaggaactgagaggttactgatgaccatattagattgtatttggatggaatgtagaaacattgttaattgttcacttaattattcattcattatttcagcaatgaacattgattaagcacctactatatcagaagctgcttaattatcccacatatgcaatttctccttcttattagtaatagaactctttgaactttctatgggacactatccccccagctagatgcttgctgctgggttatgtgtgcaacatttccttagaaggaaaacttcttaccttccaccttctttctccttatgcagttacaggaatgcagatgtgattcctatggatgagggtaacctagaggctagaagaacaataggacagaagaagcctgggtccctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataattctaccttgtgccttgacaacatcaggtattattcatgcccttttctctccctgtaatgtctcttatccacgggtagaaattatattttccatctaaggtttgctcaaatattatctacttaagtagctcttaccaattttgcctctcctcctgagctgaccctatgccttctatgctgttccaggtaatattaatctcttcctttgtacttctttcacagaacatacttttttgtctaacataataactataggcataagtgtatagattccactaggggcttcagaacagaaactatcatcttattaatttttttctccctgatatctagggaaatatgttatatataataggcccttagtaatcccataaatgtttgtgagatattcactgactataagccatactctgtatttatttagctaaaacagacgtctttcatatttagttagcagaaaatgctcacatttactcctttcctgtttaccaaatgaaagggtaattgttttttcacagattgcactagaaaagtgtcttctctctctttttcaaatagattgtctttaaaacatatgacaggaaaagtgactattgttaggataagataattacgattgtaacagctagtttaaaagaagtgtcagttgctcctgttttatttttcacaggatagagctgcggcctgtctcagtatgatgttttcaggatctggtatatatttttattttcctacatgaatctttcatccttttactgacatttattcattttatctaattatcctaaaaggaaagctctggccaggcaaattggttgttgtctgcctctgaagagacattcatatcgcgtcgcttagctttcaagttttgtgatcaggaaccctcaggcccatttttaaggaggtttcaggctagctgagcttcactgtctcccaaaatgtacaaaatgagattacatgagggacaagatcaatttactggaaggtacttaagcagtaaatctggagctttttgtccagtcactattgctttcaagctttgtagcagaaaattaagccacaagagctttgacaaattagatattactacctctaattgtgtatgtttaagcttatcacactgaattgcagcattgtaactgactattatgccaacaaggccttcgtttaatcagcgcagtgccatttaatcgcaattaatcactcaactaaaatgtcatattaaggtcacagaaacttgaagggctaaaagaaaagagaacattaaagtcagctgatggaggaaaagagcatggtgtgccaagggaagttctgagcactctttttcattagaagctggtagaacatttaatgagaattcagtcttaactttcagctgagatcagaacaacgtgcctcacttggttaagcaggagactattctgcccattcttagcgggcttctgtctgtaaataggatactcctgcccacagaatacctgaaattttacagattcatgatttttatttctattattctttggctttctggcattttcccctttcctattacttttaagaaggaaagaaatcagatatgatatggtactgaagacaagatgaaataaatagcatcattttgcacagtcacttacaaggtatttataaaaaggaacaattggattcacttgtttgccaggaagattttatttcccagaaaacttgtcaaatcgaatgttatagtgcaaaaagaaaatgactgaagcttttgttttttaaattttaatactcaagaagtactatgccagtctgaaagatctctgttagcccctcacaggacaaaacttgtgagaagtaatttcacccggaggaccgggactctgccacccatggctcattccttatgctttaaccctgcctagccctaagaaatattgttccactaactgattgactctgaaaacagagccatggtaaagggtatatagacaaagggcacacttaaggtctctctttgttaaggagtagtaggtaattttattttattttgttttattttattttattttatttatttatttatttattatactttaagttctagggtacatgtgcataacgtgcagttctgttacatatgtatacatgtgccatgttggtgtgctgcatccattgactttttcagcaacgtggatggaactggaggccattatgttaagtgaaataagccaagcccagagggacaaatattgcatgttcccactcatatgtgggagcaaaaacagtggatcttagaagacaaaaactagaatggtagttaccagaggccaggaagtgtagggggaaagaagacgaaggagaaaaaagaatataaatgtatttattaccatgaactgtacacttaaaatggtaaagatggtaaattgtatacatgcatctcctcagtaataaatagttttttaaaaaactgactctaatgaccactcttcaaacttgcaataaatagcacagacactggaaacaatgaccacctccaacaggaaaaatgaatttcagttttcatacccactgagcctatgaagcttggtgagcaagatgtctgtgtttgagcaaggctcgctcaaaccgtctcctgcagacctgtgtggaacggtgcagtccactagccacacgaggctactgagcacttgaaatgtgactagtataaattgacatgcactgcaaagatgaaatacacactaaatttcaaagactgactttaaaaaaagaatgtaaactcattaataattttttgttgattacatggtgaaataccaattttggagtatactgagttaaatgaaatatgttattaaaattaatttcatctgtttcttttcactcttttcaatgtggctactaggacgtttaaaattatgtgtatagctcatatcatatttctattggacagtgtttgtatagaccaatgagaagagtcacttacatcggtatcaccactgacctggaccagatgtgatccagtaacccagaggagaaacatttctgacctattctaatcctctaagccaaacaggctcttaatcaaagagctagtgtttttacaatatcaaatggaaaataaatataataacctcaatagtacacttgaaaaaatgaaggattaattttagaaagacaggaactggcattattcagattgaaggaaaaaacaacaaggcgaaatttaataaatatctcctggggacatatgagacaggttaagattgcagcatgaaggctggaggttaacttaaatgatttcttaagagtcagggttgtttaacacttgatacaggttgtgactcttcttttcctggagggcaatgataataaggcaaggcctcctctgaagtcctagataagcataagattggagaagccaatttaagatagctatgccatatcagcacttattcagatactttgagtgcctctgaaagttggtgatgagacgggactagattaccagccctttcaaacacactgagcctcagtcagagccatctttaatttctctccttaggtgttaataaaattcatcttaaaatttattactttatgatatctcaacattctcttacaaaatttgcacttaaaagcttatcaaaatcttatacctggaaattgaatggaagcaccttacaagctgaaacagtgtctttatttataacagtaaaaattacctttttattataacacacccttgtacgcatgtaactatatcatacatgttatataactaaatgtgtatgtgcactataggatatagtagccattcaaaaacatttgatgagtgaatatatgttcactcacaattgaaaaaaaaaccaaatgtccgcatttccacagctgaggtagagaaggcagctgaagtgtggcagaaagcccagcctctccagttctggtccagtgcatttatattgcaaaacgttgataagcaaatgctgcacatgggtataataaagtttggaaattttaccaatgagatgtagtgttagaacaattttatgccttggtaaattatcaataacttctctaaaaatatcgatgttttaaaatctcttgcaaggtaacttcctcagagagcatggctttatattagtaagtaaaggaatagtcactacataggtcagtatgagaaaaccaaatggaaccacaaatctctttctaaaaattctacctaaataaaagttcctgatcaagttaaaagcctagtttatagcacatgatgctttgtctgatctacatccaaggtaacttcttgagtggaagactttgggcttttttagacaaaggtttctggcctccatttttataaagcctagttaatttatatgctgaggtcttcggtggatcacaggtgtattttctctatatttataaccacacatcaatttttaaatggaaacatctgagctttcagtggctatgagccagtcttgagtgaggaagccatactcacacaaaacttggtataataaccaggtgtagccaaaataaggcacatccatatgcatgttgagtttctgccacataaggaatttataatagagtttatcacttatcagaatgtatttgggcttacactgactccattaccaaggaaaagcaattttaacgaggctttcctgtaaggaatctattgtttcttcttcctaaactatcaacttcacctgaaaatacttctaaaaatgagaaaaatagttaattttcagccattgagtctacctttggctggatgtattcctttaatttcagtgccaacgcataactatttggccttttataaaggttgcgtatttttcttctgagtagagttgccctcactatgtcagaaaacatgcatatgtactcttccaaatgaggggagggccttatagcctcactgatgatgagcccagagtgagtcactcaggatcttgatattgttttttgaaaacaacaacaacaaaaatactggtgtctgtatagaaaatgcctaattctttccaggtatcaataaattactttgctagtcagagtatcaatgttggatggtgttgtgaggtttacatccatgtctagaaaaccacatttatgctgcaagcaagctattataaaaagacgaaaaataatatatttttaaaggactttccaacaagttattggaactgttcctttaaatattaggaaagcactccaactagtatacctagtatactacctggtaaaaattaaaataactactacacgctttttttggaagatctgagtgatatttccaagtgtcctaaaaaacaattcttcttccccatctcaatccctaacctcttttgaaggaacagccattgtttgagccaggcaatttaattcttaggacttttatcaacatgacaggtctcagcctaaaccagggaacttttttttttccttttatttgttttcttttcaagatatagatgatatgcccctatccaatgtacagtttagtgagatggatgacacttcactcactggcagttcaaggaagtcttagcctagcttgtttacatgaacacgttttagaacagccatatagcttccagccagctctaccctgctgcccagcactaagggggaaagcaggcagtgagcccataggtcgctgataaactaactccccatttggcaagcagggaagggaatgataagggctctgatttatgttttatctgtcgctaagttttcagccagcctgaaatgacttggttctgttatcacctcagatgccacaggtttcttaagtgaggcagattctttggcgacttttaaaaagaactttatttcacctcttgcagaaggttagcttagcgatggatgctgctttaaaacactcccatctggcttcataaactgtgaggctataaaccagcttgtgggctctattccatggttagttcttgacatcacctgcatgtaactatgctacccttttggaaacacaaagctgggtgtgatgcatataatgacagggatgcttgaatcttttaaaaaaattacatacctaaaaatgtgttaatatgaaaattgcatacatcatcctacccaaacttatctaaaaagaaaactttctacaaattaattttctgtcaacatacgttgacttcagatagtaaaaagaaatgaagaagaaaaatctgtcttgagggagaaaaagagtgtcagtggatacaattagaaagcaaaaaaaaaaaaaaagcccctgttttctgtgatggatgctgcagggcagctctgggggtcagtgggagattagctgacataaaagcaagggagtgtatccttatctagtaaactaacacaagtcagtaaatgaaagccctcggtccccaacctatttcaagttgtttccccctaagtttaaattggcttgtcgttttacaaggatggatgggtattatttttaagcctttattttacaatggaagaatgtgagtgtttcacaagtgaaatgttcccatggagaagggaatagcaatgaatcataaacagtgtaaacactcccaagcttcttatatatgtaaggttatgtgctaatatcttctctcccagtagtgttttctttccaaacaccgtaagaagagaagtaggggccagggagaggcctttggagctatcttttgaaaacaatgggagtctatctcctctattctcaactgtgtaatctttttgttatctgacgtgaactcatagaaactgactatgtatttcccctcagtaatatccttctgtgacctcctctccacccaccttccttcaggataaaatctaaacttcctagcaagctgggaccttcctaaactagacctttaggattggccactgtttacccatctggcctcctccattgtcactttcccacaggcactttttacagaaggcacactaaagcacctgaaattctttgattatttggtgcctttatactttattgattttacccttgtccagaaaagcaacgagatttaaaatatcagttttgatcactactatatttccaaagcctaaaactgttcctagaacttgctaagcatcaaataatgtttgttaaccaaataatgtacacatgctccttcctggatttgtaaaacccttctcctttcttcccctgcccgaatttttacttcgatttcaaaattgtgtcactttgtggaaatcttctacctcccatatgcagaactggaaaaaacatcatcctcacagggtcttatagcacccactgcactccttcaacattttctacattgcattttagttgtttgtatccactagcagagaacttcttacaggtgggtattattttccagttctgtgtgctctgtgtctaggtgagcatataatgaattcaactaatgcccaagttccctctaggcccaaaggcccagacaatctgttccctaattaacctttcagatcacttctcctacttctccccactctccctccccctaatctagtcacacagatttccttgcctttcctccacatgcaatgcaaatcttcatcccctcccactgtggtccttctgtctgcatcactcctcctcctgaaagcattctgcccataactctttcatcatttttgtgcaaattgtcacctgcttaatgaggtctgccttgcacaccctccctgaactgcaatcgtatccaccctcattcctacccctttttcccttcttacctcctgacacacaatatggtgatttgtaggtgcgttgtttttgtgtgtcctccatttgatctcaagtttcaggaaagcaaaggtctttgttttattcattgaagtatcttgtatcttaaagcctggaatacagtcagcaatcaataaatatttgctgaataaaatactgaatacatatttactgtttttaaaaaaaatatatatatatatataatcaattacatagttgaataaggtcattatctaccttaacacatgtcctttctttgcctcaataaaagctatagagtttttcactgcttcttttgaaagtccaatatacagcctaattgaattcacagttcagttcctaatgcctcatttaaattttccttttaaatcgaattacttgtcttcataaagaatactttctttggctcaaacttttcacaaacttgcaatcttgcctcgtaagccacagttttcagcccctgtttaaaatcatggttgatttttaaatcagccttctccactcttgatgacttccataaaaatcagtttgtaagctcttaaattccttagtgtattcactctacacattgggcagctgagaaaaataggtcaggagctggactggggctcctggaacctcagcttctgaagcttcctgttgctgtacaattgactataaaagagttcattttccctataaaaatattttcactttatttatgttcccactttttttttaccacaatttaaaaaaaccactaaaagcacaacataaaaatatttatacttgttttctcatcaccacactggcatgcgatccctggcactaagcatggaaaagagacatcactggaagtcctgtgtacaaaatattattctctgcatagtgctatcattagaggatagggacatccaacctttactgaaatgtagcaatcagatatgtttcttgagcttatatatgggtggttgaacaatggttttaagaaataagatcatcattttgtttttgttgttgttttttgatttcccttttctttaaatcttgctgtgccttttctaatgtatttcttcctttttacttttttgtgttttttcgcagttatgtaagtaggttatctcagattagcatcctcattttaaatttattttatatctacttacatttgtattagtataattagataatcgtgttacacagttcctttttcctcattcaaggatatgtcttacccatggcattatcttaggtataaatgttgtcttctggattcacgtctacttaataacacataagtaatttggcatggactaactttatgttagttataacatgaataacaatacaaacagtacatataatgaatcaatatcttaaatcactgtatgatttataatttttgcatgtactctgttaagaggctttatcagaaagggccttaattattttgaaattgttttccatgtcttaaaaatattgtgctgagaaacaagatatatgggccttatgtacaataagacaatagttcatttgtgtggaacatggccaaacacaggctcaaccaaatggtatcatttttttttaaacatttactgagtatcttctgcccatattaggcaaagacttggtgctgactttatatttgagcaacacttatgatgttccatgcattaaatttaacctccatagccctctgaggttaggtgtcttaaaaaaaaaaaaaacctgtaaaagtaactttattcaaagtcactgattttgtttagtggctctacattactacattcacattcatgaaattaataatgtactgcatttcaccagctgttcataagactttcctggaggcaagattggtacattcttagagaactgggggaaaggttattgaaaacctcatgggttaggatatatccaggatggccaagcccaatagattgccaagattgaagacaggggttgagttgggatggctggaggacctgaggaccagatatttacttcacaaggtgcagttatgacaacaaaaactttagagtgggaagtattctatttttataaaatgtatggtaggataaaatgttaaggtaataattacaacaattgtttcactgtcccccaagctttgccttcaatgtacatagatagtgaggttctcatctccacttggcttggcttgactgtcactcagtacttcaatatagaataccaggagactgagcctcggtccgcatgaaagagaacaagggtttgagggttagggtttttcatactatcagactcctgggcttgggaagggagtcgggcgagtgtcaggtaaatgggagctggattgaacctcagagatcagcctgagcaggaaatcaggaactgtttgtcaccagcagccaaaagccccatgggagtccagagattatccaagctctgttcatgtacccagtggacatcccctgactctcttggggttcataggggtgatagctgtccttccctctatttgttacccctctttgaactttgaacaggtggttcagctcatacattacaaagaaaaagtgacccatcacagacacagagactttctctactcttaaaaaacgcacactgtctgacagtgtatgcccaaattaaaggctatcaaaggcacagggtgaactggaggttaaaaattaccctatatatttttaagagagttagctagcccagcataaagtgaaagatgcatttgtttccacttattcttgaatagctttggtgcttcacaacaaagcaggatttgtgttttagctgtttggataaactaaagctggataatgatagtataattcctgaattcaaataatcaagattctaaatggagtctatgactttatagaaaataatgttaaatggactatatgatattacctctctctttgtgtttgtgtgagatagagatatatttagtttgtctcaggtgtatactactaagctccaggaaattgcagtgaaacatttgttcacttttaggatttgagttataaatcagccaagtaaagatatatcctaatacaagtgtcaaaatgatgaatgatatcagtattgtaccacgtgccgacaccagacgtcactgctgttgacaagcttgtgactgtttcactaacagactgtgtctttccgagaatgggtttagtacttggagatagcccttccttggataaaagcttgtgcagctgtcatccaggagaacctcagtgcttctagaagctgccgttttagtagaaaatgtaacaaacaattcttcctcccatagctgtgaatctgaagtgagaggttgtgttcttactgcctcactcctgagttttgtctaaggatgtcactgcttctgaccccaaagtttggagagagattttgaaatttgttattatggatttatatgctgctccagaatgcctcaccaagagcttaatgctctttccatcaactttatttttaaaggaaactgttcagaatatgtgttcatttgttgccaaagatattagtgataaaatacctaaaatatgtatagcttaagtcatacaattgcctaataaattagtaccaaaaaagcataaaacctcaagaatagttaataatgacccaatattgtgttacactgtggctgtaaaaaaataacctgaaaatctttctagaaaactcatgggtccattttgtatgctttttaatattatgggtatccagatgtgtgaaatgtattctgagacgcagaatgaagacattcgaggtcatcactgtgaccctgtctaccaattttttaaaaattcaagtgtaaacaatgatacagacaatcctacaatgtacttctctaccccttactgagtttcagtggtgatcccattttatccttagacacctcccaacaacattttttcaggaatattaaaaaaattccagacgtgtcatttcacctgtaaatattttcagcatacactctaaatgctgcgaacttttttctattaaccaccatgctcccatgccaacaaaaccaacagttgctaagtataatctatattcatatttccaatctatattcaaactaccctgattgtcttaaaagtgtctttctacagctagtttgttccaataaggactcatataagatcaatacactttgttgttagtcaattaagtttattttattttgtaatagtcctttttcaccctactggctttgcatcattgttttgataaagagattagaattccctgtgttctgggtatggccagttgcttcctattggttttggttttggggtttttcttataaactggtacttagatcaagaagcttgattacattcagcttcacttattcaaacatggtgttgagtacttggtgttcttagtattgctaagattgatcagtggggtcagatgaggtcagcccaattctctattataatgatccccatcacactttcacttaattatttttttagcatatattgactatggctacacatagccattattttactggagttcacaaaataatgattccctaattctgtcatttccgaaattttctataataagaattgtaccttatgaattatttagttactctgaaatacagatcatctgagacagtcacaactgtttttctttatttattgatgctcaagataatgtgttatggtactagtaaccccaatcccaaagatgctgaaagtgtcttttgttttgagttttaaaattatcctaatgaatgcatagagttttatatatgtgatgtgttttaatcgattgcagttttgtttttatactaaaactctcccatcttaggctggtggaatcctcttcaagttgtctcccatgtccctttgacatgattgaatttctttttaatacatttctagtttcttccagcctcatcttatatatttccttgacctactatcagccatttctctaagaaaccccggttcttattagtgggaaatctgaccaccaaaatttgatttttctaagaaatattgcccttgagtcatgggcataaacatggcacgtagtatcattctctcttttttttttttttttcaaatttcccaaagtgtttgaaaatgctggacattgtagaaccttcaaatagaactttcaaagtttagcaagccaatctgttacctctgtaataacttgaaatttttacataatgtgtggatagcatgcacaagtgttttcatcttatgtttttacaaattttatttaaaaaataatacttcagttttctgaaacaggaaccatgtacaccagtgttcatccatcaatctcaaaatgtaagtgcaatatagcttaaggaatgatgtttttaattatataattattttttctcacttttaattataaaaatcatttgtgaatatgctcttcttacactagtgtttctataatggcatattcagtgctcagctcccaggtgtaagtttgaagtatctttttagctaaaatttggataaatcaaatccatttgtataaaaacaatttgaaatccagatttattgcctacaatctgaaatgcaacatatggggcacagctcccattcctttgttgctacgtgtgtgttcttcattctcttggaaaaggccccaagggtgcagaaagcagagggacacagagaaaagactccatttcacctactgcctgaacttctttgtggttctatgctatggttaggatcagagagataaggcttttgtaccaaagaaggaatttctcagctcagttgtcttcagaaaatccctgggcctagcaggcaaagatttctgttctttctagatgtctttcaaaacagtgcaatcccctaatcaaaagctctggaaacttctctacaattagaatcttctgaaattcctaagttctattcactgtccaaggtgcatacatctccacataactgtctttttgttgttgttgttgctgccttacttattttgatgaattgagcctcaataggtacatttctagaatttgtgctatttgagcccttgggaatttgtgaactattattttagaataaaaatgagcacactcagcattagaagatatcaaagggtgagacctcatttagaaaggagaagaggcagtggtctattgtcttctctacatttaattttggctttagggtactgtcaggtccatgaaagccagtagtcctgaaattggcctaactgtgcatgctcccacctcattgtcctttgaaaaagattcatataagtctttcctttttacattttatgtgctgaacttttcattatcaaatagagtgtcttgtggccttctgaaaatacttttcaaattagaggaagtttgttgttacttttctcttatgaaatagtaacaaacccttatcacacacaacacttattctgtgtgacagacacagtcctaagcactttgcatagattgctccacaatagccctgtgacaaggatactgttatcagtctcattttatagataagaaaattgcgatgcctagaggtgaagtaacaggcttggcatcacacaaacaattaggggcagggatgtgatttcaacccaagcaatgtggctcccactagtctcagagccactcaaagtgagttagacatataattagcttctgtgatctggtaccctgaggggtcagaaagacctggggctttgtattccaattgtctggagtttaattttggaactgtggtaatactataaagccattctcagttactataatggaaagaactcctttctaaagtaaaccaagcaacatatatctaggtctgtgataaataaaattgatattgtatgtttccttgaaggtaaatagagtggaaaaatatatatcgtagtatcactatagcaactgtattttgtatcagttcaagtttctgagctttaatttgaaagaatgacaaaataaggatttggaagcctgaatcaaaggaatgacattcgtattagaaagtatgaattagaatctggactaattgcaatgaagtatgaattagaatctggatgaattaattttaatatataaaaatattctaaatgaaaaccatgcatccaagagtaccatggcccatacagaaaagttgatctgctatccccaccagcacctggtcctctacaaattattatctacaaaagtggatgtcactgaagtcaaaatagaaagtcaacagatctgaaaccatggtgatgcaggaaaatgatgagtcgttccccataatcctgtgccttcttgaggtcaaggtaatattgctcccaaatgtcattcagttctgtggcatcaaaaggtacctgctatgcactaggcagagaccaccaacctctggatgggcttggaacccaagtctctaaaggtgaaaggtcacagcctcacctcacaacactgccttgggcctgtttcttattaccaaataatttccagaaggagatcaggcttgagcctgattttccagtagctgtgcaggggagaaaaagagtttggaaaggaggactgctgttctcagtgactgattgtgagaacaagagtagtgtcaggaaaaaaggccactctcccccggccctagtcacaggataaattgcagtgctcctggctgctcctcagaggaaagaggcttattggcaggagataggaggcaatgaggatccaccaactgacggaccagcaaattcccaggaccccgttcaataaagccactgacaggcacagtccccaaagaagagaggtgaaaaccacattcgtgtacctgaggtgaaagaccaccattaaaaataagtaagaaactccaaatgtgtaaatcctatataagccaaaccatatggtataaaatgaatacattttctccctctacctttggcaaaatggtttcttactggattttatatacaggaaagtattaacccaccttttgccatgtagtttctccctgatatatggcattgataatataagtagttcaatgatacttccactgtttgtgtagctctgcgtataaaaagaatgctgtgcacatagtagaagtgctaaaatcctggggtaacacctcatacattagtggccttccatggtgaacaaagtcatttttcaagcaagtcataaagtagcctaaaacacaagtgtttcagtgtttgctccaaatgaggcagtggtccggggactgccgttcatctgacatcatttctgacacagccagcgctggtttggtatctgattaggactccccgccacagtggtgccagacttactactttaagtgaggtggctgagggaaattaatgtgtcagagttaccaggaggcgagagtgtttgcttcaagtttcctttggaaagcttcagctggaattgcctttgattctttccaagagaatcttttgaagctatttatggagcttggtaataggtgaagatgagctaccaacaggaaactcagctagcatcaaaagtcaagcgtgcagatgtgcaacgatatttctagacaaaagtggtcaaattactgacttgtttagaggatgccttggggtctcctggcaagtgaagtagccattttcctcaaggctgaattttcatgatgcaccctgcacccgctgctttgttctggagaatcgtatatgccctcttgatgtcaatgtatttcccttaaaatataagtgaaatgctgcgtacttcactgatgcatgagaatattggatagaaatacccataatgtgctttgaaactttttgatgaaaagatgaggtatacttaaaagtattaactctgtaatgtgttcctttccatcccttctcaccctcttggcctaggtatacacataaaacttatcccaattcccagccctcttcacttccactttctgggaaaactatgggaactgtggatggaagattctgtggtgcatattttctttcttcaactgaagcaatgtacacaaaagaaatctataaatcttaaagtcagccagaaatatcagttgctattatctttttttgttttagaaaatatagcataagaatacatgctttggatcagacagatctggtctcaaatcctggctctgccatttactcacacatatgtacagctcaagcatgcatgtatgcattcacatacacagacattgacacatgcatgcatgagtacagtcacacactcctcatgcatatgttcaaatagatgctcactcatacatgctcacacacatgtatattcatggacactcattatatacctgaagcttaaacacacaattcacttattctttgcagttacgtatgaccagcagttctgcagctatacttgagcatgattctgtgctctccagaaggacactttattttaaatcttttatatagcacaggaagctttttctcttagtttaaaggccaacaacatcaatttgcagctagaagattgagtttaaatcccacctccactacacagtagctgtgtgaccttggataaattactaagcttgtgtatctctctctcctcatttgtaaatcgggaatttatctcacaagattgagatagatactattattattcccgacttacaaatcaggaataagccattcagaaaagtgcttggcacatagtaagtgcatgtatttatttgctattaatattaaggaatgaaactcagcacagctagaaggaagatttctgttccaacacagccttgaatgcaatttctatgtgtaaatgaaatgtatttcatgtgaaataacaaacattcagatcaggtcatcttaatactacacatgacaaagatgtatagtttaataaattttgggctttgctggtttatccacagagagggtcaggtctgtgctcaagtgtctttcagaagacatgagcatcttaggctcaaactcttcaggagatgagagtctgcagccctattaacagcctctaattgcctcaaggttcattttaagctctaattctaaaagtacaatgataggcaagtatctgccctctcagaaatcttagagactgggtggggcactaaacctgaaaggatatagagtccatgtttaatatctattctcttgagtgatatacatactcatcatacttgttagtactctatttccctcctaccaaaaactcttacatagctatatcattttgttttataattagagttgctttgagttaataaaaactatactaaaatgtttattttcttgcacgttctttttatacaattatgatgcactttagagagataaatagtgcctgaatttggaattctgggactgaacaatcagccttatgggatgtgaaaagaagagaaaggcatgagttgagtaacataagtaagcaagatttaaagaaatactaactcccaaattaacatttttggttattaattctgaattactcagcattacagcctactgtaaccttgatttccagcaggcttgaaaagagatctttcatcaactcgagtgaaactttcttttgtaaaaaataccctttgacctaggttacttcaggtctacatgacagttgaataagtacatccttgcagctttacatcttagatagaaaactatatctgtgtcttcgctcttctaaaacctgctattgaagcagtttcataagagttcataccccttcactcttcctagggagccatggagagcctgcagctgaggtactggctttcccgcagctagaagtctctagtcactttagcaactcatcacctgcttcccatttttttaaaagagtgtgaactgcttgaagttttcagataaatataataatgcctatatttacccaattaaccatttctttctttgagataccctgcctccaaaaatatttgatataaattatttttggaaaaggtttagagttttgaataaattacaattaaacagttatatttaaacaaaacttaacaaagtatataaataggaataaatgataagaatggaaataattttttaaataatctactacttatcaggtattattctttatttagattattttacttaatccctacaacaagcctgtaagtgagttacaagttgttaaggataaggaaacaaaggaattatctaaggtcattcattatatgtgtaagagatgagatttttttctagattgaagcaactaaatattctgcttttctaatatagaaatactttatgaatattttaagcatgctacttatttttagtatcattattttttaaatctagatttattaagggcttagtatgtactgtgcataatgaaaaataggattctcatttttaaagattttataatttggttggagagagaaggcacacaactcatactctcaataatcatgtcactctgtaaaccagaatgtggttgtttgtccaaataagtggggcaaataggagtaaagaaaactaggtcagtatgcatctgtggaaaacctcttggaggaaaggcaatcaaaccaggtcccaaggatgggcagcaatgtatgagaagaaggcagaagctatcaccaacctggggttggagctctgtactgtgcattcaggtgacgacagggaagctccccagcactaacaatgtgctctgatagaagagtagtgacaagtagagggatgaccagattgactaggcttgaaattccagttggagagtctggacttaatgacataagcaaagaagataatatcagaattttatgaacactaaagagtcataatgatggcagtatttaaaaatatttatgggaccaaaaaggactgtaattgactatacagtttggaggataattaggacaatttaggcttgaggtgatgaagtctggcccaaggtgatagtacacatataaagggggaaaacagaacctgaggactcattagatgtatgagatctaggggaaatgttcagtgataattgtttgatttgaagaaatagttttacaatgtatttgattacacaggagaagctatcttatctgataaaattgatactggtatttggttgtataagtgagtaagttaaaaaaggaaattactagaaaaaataatatataaatgtagattaagcatttttagttattttgaaaataataaatgctcatgcctttaccaatatttaatccaattccaagatttcctttcatgaatatgtttattgggggtctaaatcatccttttttgtgtgtgtaaatcacacacttacagcacgatttacaattccaagtgcttctttaagtgaattcaaaacttaaaaacaattccaaaacaatatgattttaaaaatttatctacattttgttttttccaacctctcaagttatatcacctgtatcacattctacagcagtcaattcagtgacttgctttactaactctttccaaagcactccttttatttttcatagaaaaaatatctttttgcactatttcattgatttatataatttctaattatatatgtataataacaagtacaactggcataaataagtttagaaaaatgcaattgactctcgatttgaagatgattcaagcagtgaccacgggagtgcatgggatcctagagcaaaagcttgtaggtggggtgggaaccctcaatggccgccaagcagcagtcactgtgttgtattcatagaatggaagcactagttcatgcagcaatccagcaaaacagagactggtgaagagcttatattgctccacagaaaacacattcctaaaagttaaaggtaattgatatttatggtagttattgtgtgcattaaaatggaacttgacatgaagtgtttctcatttcattataagagaacagcttgactttaaaaatataaacgcttcatattttctctgggggaattgttagtttaaaacacaacaaagaacaaacctaacaattcctaaacttacagcaaaaccagggctgtaagcagataagaaataattagaatgtgctattataaggtaataagtttaaaaagtatatttaagtcatagttgcactcatttcccatattcttattttgtttttgtttttgtttttgtttttgagacggagtctcgctccatcgcccaggttcatcgcaggcgcgatctcggctcactgcaagctccgcctcccaggttcacgccattctcctgcctcagccccagagtagctgggactacaggcacccgccaccacgcccagctaattttttgtatttttagtagagacggggttttaccgtgttatccaggatggtctcgatctcctgacctcgtgatccgcccgcctcggcctcccaaagtgctgggaatataggcgtgagccaccacgcccggcctcatttcccatattctttacagattaccccaaaggaacatctacttgttttttaaaaagtatgttttctcagttcttataaaattataaaatattaatttgtgaaacctactttaggaattttttacaactatcaaaaacacaaatgtgctgggtattctagtttcctaaagaagtgaagtggagccaaaaagttaccatgcactgtatttcctcgaagtcaccctaaaggtccacaaaagcaaaggctatcataaagcataatatcccaaagtttcgtctttgacttgatgcttctatatctactatgtcatctcactctcttttaaatctaagtcttccatggatatatctgaatgactgagccttggtcatgtgctggctctctagctacaatgacaggctggttaagctaatttcttgctctacatgggcatttcagacctcaaatatttaaaagttcccaagcatagggtcttaaaattatagtttataataattgtacacaacagccagtaatcagctcatgctatcacatatcaaaatgaatcattttttaagggttaaggatataagtgtgaatatcttagctcccgattttaaaatataatcaaatttaacaaagatcaaattatctaaatatcaaaaacaacataagaaaactcaagtgcattaatcattaaagattattctctacgattttatcttttaagcccctatatgtgatatccatgtcacatttagtcttttgagagattttcaaaaatccactttattgggtatgtttcattttacaagcattgggatgaccattaaacaactctttggttgctcagaaatttttaattatggcaggatggataggcatgcaatgtaacaccaaaaaatagcaattcattactttgatgacactgtacttaagaagcaagggagtttgttgctgagtactttagccgataaagcattcatttttcacctcctctcagatctcagttttggctgcctctgattccttaagtaaaattaattttgttatgtcgactatgctaccattagttgataatccaggaggcaagagatgccatgcatatttcatcattccttcgcatcacagtggttctgaacatgggctgaatatagacatcgcaggtgtgcttcgagatgactaacttaaactttagctcagaatttttaaaagctggataaattgttgacagtttgagtagaaccagtgagacgtttgggttaataattccaatttctataagggaaaatattgtcagatttaacaagattaacataaggatgttctatggtcactggattaagaattcatgtatgtttcttacattaactttgtgggaatataaattactttgggagttttagtgttctgtgtttgccccccattaggacctatgaagtccttcaggttagagatgaaatcctaaatgtctagtatgatgcttagcacagagcacgtgctcaaaacatgtgggcagaaacaggagtctaacttgcatgagggctaaatgatcccactaggaacaggatcaaagagggttttggaaggaatgatcaggccctggaatgcaggaattaagattgaaaagatgacagaaggagctttccaggagtatctcagatagacaggaagctcatttagaaataagaaataatgagatgtctgagttttatcctaggctgctgattgagttgaaggcagagtgcactaccctgttaggtgagtgcttttttggtaccactcaaatgtcctctgactcagccttgggaaaggttgtgacaagttccttgagtgaggggcattagaaaaccgaaagaaagagatagctttttccaacagacttgaaaatctggggggaaaaagtcaactggaaagcactttgggactttgacaacaagttgtaagggcagaggagagcctggagatccaccctagctacacatctttgcgataggactggccctgagggttgggcatgacattcctaatcacagtccctatacctgggattgagatgaagatagtgtcactcaccaaggggatctagacgggatgatgagtaacattagctccccatcagggctgacaagtggttgagtgaagataagtgccatgggcagcagcataaagaggtaaactgccaccaaggaggatgtgtgagccacatggaatctatctgggaatgaggatggcctttacgggaaaactccaatgtgtttctgcactcagacccaaagaccaattatattactattgcagtaaatttactcacactacgattacacaaatttattgacactacaacttagatataaagaaaaaatgtagttaacttattttgtctcccaactggtctctcaagagcacttacgggtattaagacacagagaaaaggtactttttcctgtttcccattcaaactcttggagaaagattgccttttagactgccctgtgccactctgaaacatgaccacctcaaatttggtggctccatgcaatcaggcagaagaaaaccttgatgcaacgctttcttgggctgctttagattgcacctaataaataatctggatgacaccaagaagttcccacaggtccctgggtggggctgggaaggtggatgagttgccaacgaatggacctgtcattggacctgcctcaggtaaaggtgaggtgattccacagaaggagtcaggagtgaaacgcctagcagggagctagatggagaatgaggaatggatgaggcttttttatgtgctgccctagattttcttggcctctcccatctcctttctcttttgctccttgctcacaaaagagactagctgctgtgtcttatatctcattagaaaggtgattgaatcatccttcagagtgacttaataacatttaaacaataatattatgataacatataatgaacataataaacgttatttctgagtagcccccaaagcaagatatctctttaataattaaaatttcgagataagaaaatgatgcttgcattgggaccataacataatgttttttctttgtcgtctctgcatataaaagtaatttcagtctacctgtaagagcagcatttgcattatggaagtttttgtttgtttgtttgtttttgtttgagatggagtttcacccttgttgtccagactggagtgcaatggcgcgatctcggctcccggcaacctccgtctcccaggttcaagcaattctcctgcctcagcctcccaagtagctaggattacaggcatgtgccaccacgcccggctaattttggattttgtagtagagacggggtttctccctgttggtgaagctggcctcaaactcgcgacctcaggtaaaccacccgcttcggcctcccaaagtgctgggattacaggcatcagccaccacgctcgtccagaaattgttctttaaacatgattcaaagagtaagaactatgttaagaatccagtgtgagctctcatctaggctaagttccattaaagttttgggtaacaagcttactaaaatgttaaattagacttttttcaccttattaaaagggaggaggcatcatttgggacaacataatgataaaattgtgttttcaaatttaaaaatctactatcagtaattctcatcacactttgttttttaaaatctgtgcggtttttactgcctggggacataattagcatctggttatgagcaaggcggggaataaggtggagtgagacatcctggtcctggccctggttatcaagaaattagacaggttaggaacagccttctctctcctaaacttttacacttgatcttagacaaaaggccgagaagtgatctctcccaaacttttaaggcaattattgcaaaatctagccagctgaaatatacaaagacaaagatataggttttagagagaagaatgatgtgatcaaaataaagaacattatgtttcaaagtgactgtaagaggtaacttataggaagtcagagagaataaataaaaaagaatgtgtaattcttgaaaacttttctctgccatacttgagatcatgaatattttttccatcaaacaagaaaacaaggaaaaccattttgctaaagactataattcccctaaatcacagcacctatattttgcactttttaacacattgttcacaaaataattaatacctagaaactgacagattgtggactctgaaaacagaaaagccctatgatcaattcttgatcatttccctgtatattgtttacattatcttttcctatctctccaggcccctattgatttgaattaggtggcaaaaggatatttgattacgttagatttctgccctaaggttaacgagtaatgtttgtgatctgaaacagggatattacattgacagtgtcaggaacgaccccagctgtgcaaaaaaggtgtcaaaatgccaataaccaagtgtgtggtgaaggtcgtagagactatatctggccgcttggtgggcagatcataaactcttaatcagtggtacttgggctgggaaagcctcataatttatccacacatgtcttttcttctgaataccacaccccatcaattcacagcgtaaggctttgaacattttcacaagcaaatctcaaggtatttctttctaacttccatttaaataggtggcaaagagaggcatctcctttgctttcaaaagtctaattattctagacctccaatgcagctcatcctttttcatctttttaaaaataaactacagtctactcgagggtggagggtggtaggagggagaggatcagaaaaaaatacctattgggtactctgcttactatcagagtgacaaaataatctgtacactgaacccccatgagacacagttctcctatataacaaacgtgcacatgtacccctgaacctaaagtaaaagttaaaataaataaataaataacatatgaactgagcgtcttaaaaatgatacatccttccaatgatctgaatcatgaggtcaatttaaactcccaagtgtcgcagaatgaggctctgcactgcaatgaacgtcagaaccagtttacagagtttctaattcagttttttgtggcagttacaaagactgcccaagtcccccacttgtctggttttaaagtggctttaaaaatttttcatctgttttatccaacttaattttgatgattatttacaaggatattctttctttccatcattcaacatttattgcgtgcctatactacgtgcccaagcagaagtctgggatttgggatattagtgaagacaacacacagatgtgtgaactttgtttttacataattctttattgcattttggctagttttatatgtggaatctgtatcacaggtattcgatgagatcaggagcatgcccagctctccactgcgggcttcatgtaagaggagagccatgataatgtattgcattattcttgtacagtaatcaggtatgttgtttctctacacataagttgaatagaacagctctttttcattttcaagtttattgagtctgactctatcacctaccagtcaaataatctgcctaccatgtgttcaataactatgattcaaatcctccatgaatcacctctgggtcaatgttggggcgaaaagaaattcataaaaatggtaaattcctgtagccttccagtggttcgctctttctgtctctgacttcctttttcacttcatcgaccctgtcattagctctactttcaattcattgaggagaaaaataaaagggatggaaaaattacacacatgtgttgtggcatgtagtaatcaatgttttaggtagatactttttacgattgccctgttgaattcatgctacaactggctcctgctggtggtaagaatatagctgtgggacgtgctaggtctgcatgttgggggccttgcagtccgatcaatattccgcattgttggaattatgtttttattatcagacatgacaaatttgggtcagaggttagaaggcattcatatgtgaatccttcctagccatgactgaataatttttcttattttcagattcataacttttaacaaataataatgttctctctccagaaataggatgttatatcttaagtttaaattatcacacatactgtccaaaagaatttgaatcctattcctaccgtccccttcagagcctttctctgctattggttatgcatgttatacaaggagttgttaatgttttttttgttttgtttttggcggagcaggggatggagtctcactctgttgccaggctggagtgcagtggcacaatcttggctcactgcaacctctgcttcccgggttcaagcgattctcctgcctcagcctcccgagtagctgggactacaggcatgtgccaccacgcccagctaatttttgtatttttagtagagacggggtttcaccatgttggccaggatggtctcgatctcttgaactcgtgatccgcccgccttggcctcccaaagtgctgagattacaggagtgagccacggcgccccgctggagttgttaatcttttaagctgtgagccgtgactgtgctactgcactccagcctgggcaagagggcaagactctctctctatacgcatacacacacacacaaacacacatacatatacagaaacacacatatgtatacctctctctctctctctctctctatatatatatatataatttgtagtctaggtgaaattttaatcaaggggaaatctgaagagtgataataggaaataggtatcaagacataatcatggcggttacgtctataaacatcagcatcatttgagatgttttatatatgtttaattttaggtttatatacatatgcaaaaaagctaataaagctactaattatcttcgataagctccataaatcctaaaatgaaatattcattcattaaagatacctttctgattatgtggcttcgttaattaatgttatcagatgctactttgcattcatgttactgtgtttgaaatttttatttctagtattttttatcaaaactgtcaaaaagatggtaatgctgtcaaaagttatttgctcagagtatatttctctaataatgcttttgcttatattatgcatgctcttttttgaagaagttaaacatttttgtacattttatacaaagacgaatattatttagaaatgcaactatttaaatttcatttcaaaaaagcaaaactacgcttctcgcaatttggttgcttttacagaaaccccattacagagaaacacacacacatacatacatatatatacacacacatacatatatatacatacatatatgtatatacatttatacgtatgtatatatatctgtctgagaaacgtagttttgctttttttaaatgaaatttagatagctgcatttctaaataatacttatctttctacaaaatgcacaaaaatatttaacttttcttcaaaaaagaccagcataatacaagcaaaagcattattagttagagaaatatactctgagtgaataatttttgacagcattaccgtctttttgtatagttttgataaaaatactagaaataaaacattttcaagcacaataacatgaatgcaaagtagcatctgataacattagttaatgaagccacataatcagggaggtatctttaatgaatgaatatttcattttagggtttatggagcttatcaaagagaattattagctttactagctttttcacacatatatgtaaacctagaattaaacatacgtaaaacattatctcaaatgatgctgatgtttatagacgtaaccaccatgattatgtcttgatacctatttctgcttcttactcttcagatttcacattgagtacaattttaaactacctatctcagcaaaaataaaatctcatctcaattacaatttgtgtactcacagcataggaagcaaagctacaatcctgatatgttaaaaaatgaattacatcattttataaaaattgtggcacatcatttatttcctcattacactttctgtttctcagaggaatgatgattcagagttgtggtttacttaactaaaatagattactaagttagcataaactcaatcagtgggaaacctgacagtcggcacagttatttatgatgtgccaaatgcaaaatcatgctcctactttgaggttttgctaacaaggcacattgctaattccaaggaggaaaaaaaatctattctaagatatttggacataaacataactttacaatagtatttatgaaatggtttcatggcttatataagatatgttgatataggattatctggcaaaaggtttgtaaaattaaataagtttatattgtaactgaaaaacaaagcaactgagaaagaacaatcagtaaagaaacagattttaaaatattatttttaaagacattttacaacgaacagattcctgtctaacttttcagtttatcttaaaattgcctccttttcttttttacactttgtagtttttccaacttaatcactgaattctggaaatatttctataacactaccaaattaatgagaccaatgggctcctgtgtaacggtagattgtgaaagtcaatttgttaatttaataaattaacaaaaggaaaatggaaactatgaatccatattgcctttgatgcatttaaagtaggagagaaactttgaaaacatgtctatatagtcataaaaatattttaccataaaggatctgttcagatggcatctatgcctgttttgttattgtatcaataacattaatttccaacaaaaacacagactgattttaagagttataatttggaatttttaatttagaaattagaaacactataaatgtttttatgaatatcatttccatattaaaatatgttaggcatattttcatgaatatagaaaaaataacaaaaaggaagtatacattcaattcagcaaatatttagtaagtttctaccatgtagcaataactattctaaatgtagaatacaaaaataagtataagtggctcatgttatcaaggaccttataatttagtaaaatagaagttatgctcttgtgaataatgtttatttataatagtacaaggttgagtgcagttgttgagagattggtatatcgaaactttggaagagaaaactataatgtagcctccagtgtttaggttgtcatggacaatgcaggctttaatctggaaaagtatggacattttagtttgtggaatgagaaaagatgccaagaccagactgaaaagaagttgcttaaaaagttaaaatgaagagctaatttgcttgaataagaaggaattagtgggaaataagcatggaaagaaaaatctagtatcagatttggaggactttaaatactttcataatagaataatttttatattccagacttagctagtaaaattggtttctatcctgtaaaccctgaagattctaaaagacctgaggaatgcagtgttttggaaaggttaatatctgcggtgtattggtgggaaagacaatagaggcaagaaaactaaaatagtgaaaacatgtagttacaattaggacatatatggaaagcagtagaaatgttgaaaaggggcgagtgttaaagatatattcaaggaatatttatcctccactcagcaagacaatttccttcaagtcctcatctaaaattttttcttttatgttctgcggttgtgatagattaaagatgcctgcaaagtctttgctgcatctgccattgagaagtacagtttagttcccctctccctgagtgttggctgagttttgtaagccttgcttgaacaacagaatgcagtacaagtgatattttgagacttctgatattatagatcataggtcaaaaaggacacacggtttctggcctgtctgcttggaacacttgctctagacacctggctgccataggagaggccaacgtgaaaaggaaccaacgccccagacgatagccccagcagggctcttacccagcagcctgcaccgtggaagtgagccaccttggaagtgaattctccagacctgtagagctacaccagctcattccatgagaagcagaaatgagctgcccagctgagtccttcccaaattctggcacacaagattgtaaacaagactattttaaattctcaaattttgaatgcagtttgttatgcagtaatagataatcagagaaggagtagagaatagtatataaagtcaacacagaaccaaaaaagaagatcaaattttaggtgacatgttttgtttccaattattattattgaaacattaaatccttcctgagtgtaagtgatccagatgaaatgaaagtaattggaaaagtcttgactgtgttatgaggccttagagaaaataaaatccctttaacacatgattcccaaagcacaaaataaaatatattcaaaatgttatggcattgaaatccatgagtgtcctttctttcctttctcactgaaatttattagaagataataatctgtgcattacctattgatggtttttcagagctattttctcctcctttgatatgtagtatgaatttatttatttatttatttttaagatctactcttctactaaatttcaagtatacaatgtattattattaaactgtagttactatgatgtaaattagatctctagaacttattcatcttgcaactgaaagcttttacactttgaccaacacctccccatttccaccacccccagcctccggctaccactattctattctgtttctctaagttcaactatttttagatcccacttaatttataccatacaatatttgtctctccatgtctggcttatttcccttagcataacctcctccgagttcatctgccttgtagcaaatggcaggattttcttatttttaaaggctaaattgtactctattgtatagatatacatgacatattctttatccattcatctgtcaatagacattttggttgtttccgtatcttggcgactatgaataatgcagcaatgaacataggaatgcacatacctctttaacatatggattttattttctttgaacatatacataagtgagactgctagatcgtatagtagttctagttctaatttttgaggaacttcaaaatgccatttttcataatggctataccaatttacatttgcatcaatagtgtgcaaaagttctcttatatccacccctcaccaacacattatctcttctctttttgacaaagaccaaactaacaggtgtaagaaaatatatctttgtagttttgatttgtatttcttgtatgattagcgatgtccagcaccctttcatacacctcatggccatttggtcaggcgaacgtggtaacaactacactatggaaaccaactgttggccattttatatgtcttctttggaaaatgtctgttcaggccttttgccgatttttaaatcaagttattgtttattttttgctattaagttgtatgagttccttatatattttggctataactccttatcagatatatagtttccaaatatttttcccaatccattgatcttttatcttgttgactgtattatttgctgtgcaggaagcttaattgctatatttttgtcttgcatttacagtttcatgtcctacatttaagcctttagtgcattttgagttgttttctgtgtatggcttaagataagattctaatttaattcttttgtatatgaatagccaattttcccaatatcgtttattgaagagactatcctttttccattgtatatttttggcatccttgttgaagactagctgactggatataggtgagtttatttctgggctctctgctctgttccattggtctatatgtctgtttttatgccagcatcatactgttttgattactataactctgtaatgtgctgttgactcttgaagaacacatgtttgagttgcacaagtccacttatacgtgagtttttttcaataaaatttacaccaagcatgaatgcctcttctgtctccccttccacctcctccacctcttctgcctcttgccaccccaagacatcaagaacaacctttcctcctccttagcctactgaacatgaagacaacaaagatgagggtctttctgaagatccacttttacttaatgaatagaaaatatattctctcttccttatgattttttaaagataactttcttttctcttgtttacttattataagaatacagtatataaatacatatataaaacatgcattaagcaactctttttatgagtaaggcttctggtcaacagtgggctattagtagttaaatttttttgttattattattatacttgaagttctagggtacatgtgcacaacgtgcaggtttgttacatatgtatagatgtgccatgttggtgtgctgcacccattaactcgtcatttacattaggtatatctcctaatgttttccctcccccctttccccaccccacgacaggccctggtgtgtgatgttccccttcctgtgtccaagtattctcattgttcaattcccacctatgagtgagaacatgcggtgtttggtttttgttcttgcgatagtttgctgagaatgacggtttccagctttatccatgtccctacaaaggacatgaactcatcctttttatggctgcatagtattccatggtgtatatgtaccacattttcttaatccagtctactgttgatggacatttgggttggttccaagtctttgctgttgtgaatagtgctgcaataaacatacgtgtgcatgtgcctttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcgtatttctccacatcctctccagcacctgttgtttcctgactttttaatgatcgccattctaactggtgtgagatggtatctcattgtggttttgatttgcatttctctgatggccagtgatgatgagcattctttcatgtgtctgttggttgcataaacgtcttcgtttgagaagtgtctgttcatatcctttgcccacttgttgatggggttgtttttttcttgtaaatttgttggagttcattgtagattctggatattagccctttgtcagatgagtagactgcaaaacttttctcccattctgtaggttgcctgttcactctgatggcagtttcttttgctgtgcagaagctctttagtttaattagatcccatttgtcagttttggcttttgttgccattgcttttggtgttttagacatgaagtccttgcccatgcctatgtcctgaatggtactgcctaggttttcttctagggtttttatggttttaggtctaacatttaagtctttaatccatcttgaattaatacttgtataaggtgtaaggaagggatccagtttcagctttctacatatggctagtcagttttcccagcatcatttattaaatagggaatcctttccccatttcttgtttttgttgggtttgtcaaagataagatggttgtagatatgtggtattatttctgagggctctgttctattccattggtctatatctctgttttggtaccagtaccatgctgttttggttactgtagccttgtagtatagtttgaagtcaggtagtgtgatgcctccagctttgttcttttgacttaggattgacttggcaatgtgggctcttttttggttccatatgaactttaaagtagttctttccaattctgtgaagaaagtcgttggtagcttgatggggatggcattgaatctataaattaccttgggcagtatggccattttcatgatattgattcttcctacccatgagcatggaatgttcttccatttgtttgtatcctcattgagcagtggtttgtagttctccttgaagaggtccttcacatcccttgtaagttggattcctagatattttattctctttgaagcaattgtgaatgggagttcactcatgatttggctctctgtttgtctgttattggtgtataagaaagcttgtgatttttgcacgttgattttgtatcctgagactttgctgaagttgcttatcagcttaaggagatttggggctgagatgatggggttttctaaatatacaatcattttgtctgcagacagggacaatttgacttcctcttttcctaattgaataccctttatttctttctcctgcctgatgtcctggccagaacttccaacactatgttgaataggagtggtgagtgagggcatccctgtcttgtaccagttttcaaagggaatgcttccagtatttgcccattcagtatgatactggctgtgggtttgtcataaatagctcttattattttgagatacatcccatcaatatctaatttattgagagtttttagcatgaagggttgttgaattttgtcaaaggccttttctgcatgtattgagataatcatgtggtttttgtctttggttctgtttgtatgctagattacgtttattgattttcgtatgttgaaccagccttgcatcacagggatgaagcccacttgatcatggtggataagctttctgatgtgctgctggattcagtttgccagtattttattgaggatttttgcatggatgtccatcaggtatactagtctaaaattctctttttttgttgtgtctctgccaggctttggtatcaggatgatgctggcccataaaatgagttagggaggattccctctttttgaattggttggaatagtttcagaaggaatggtaccagcttctccttgtacctctggtagaatttggctgtgaatccatctggtcctggactttttttggttggtaggctattaattattgcctcaacttcagagtctgctattggtctattcagggattcaatttcttcctggtttagtcttgggagggtgtatgtgtccaggaatttatccatttcttctatgttttctagtttatttttatagaggtgtttatagtattctctgatggcagtttgtatttctgtgggatcagtggtgatatcccctttatcattttttattgcgtctgtttaatacttctctcttttcttctttattagtcttgctagaggtctatcaattttgctgatcttttcaaaaaaccagctcctggattcattgattttttgaaaggttttttgtgtctctatctccttcagttcttctctgatcttagctatttcttgccttctgctagcttttgaatgtgtttgctcttgcttctttagctcttttaattgtgatgtcagggtgtcaattttagatctttcctgctttctcttgtgggcatttagtgctataaatttccctctacacactgctttaaatgtgtcccagagattctagtatgttgtgtctttgttctcattggtttcaaagaacatctttatttctgccttcatttcgttatgtacccagtagtcattccggagcaggttcttcagtttccatgtagttgagcagttttgagtgagtttcttaatcctgagttctagtttgattgcactgtggtctgagagacagtttgttataatttctgttcttttacatttgctgaggagtgctttacttccaagtatgtggtcagttttggaataggtgtgatgtggtgctgagaagaatgtatattctgttgatttgggatggagagttctgtagatgtctattaggtcggcttggtgcaaagctgagttcaattcctggatatctttgttaactttctgtcttgttgatctgtctaatgttgacagtggggtgttaaagtctcccattattattgtgtgggagtctaagtctcttagtagatctctaaggacttgctttatgaatctgggtgctcctgtattgggtgcatatatatttaagatagttagctcttcttgttgaattgatccctttaccattatgtaatggccttctttgtctcttttgatctttgttggtttaaagtctattttatcagagactaggattgcaacccctgcctttttttgttttccatttgcttggtagatcttactccatccctttattttaagcctatgtgtttctctgcacgtgagatgggtctcctgaatatagcacactgatgggtcttgactctatccaatttgacagtctgtgtaggttcatattgttatgtgtgaatttcatcctgtcattatgatgttagctggttattttgctcattagttgatgcagtttcttgcatcaatggtctttacaatttggcatgtttttgcagtggctggtactggtttttcctttccatgtttagtgtttccttgaggagctcttgtaatgcaggcctggtggtgacaaaatctctcagcatttgcttatctgtaaagtattttatttctccttcacttatgaagcttagtttagctggatatgaaattctgggttgaaaattcttttctttaagaatgttggatattgtcccccagtctcttctggcttgtagagtttctgccgagagatccgctgttagtctgatgggtttctctttatgggtaacccgacttttgtctctggctgcccttaatattttttccttcatttcaactttggtgaatctgacaattatgtgttttggagttgctcttcttgaggagtatctttatggcattctctgtatttcctgaatttgaatgttggcctgcattgctaggttggggaagttctcctggatcataccctgaagagtgttttccaaattggttccattctccctgtcactttcaggtacaccaatcagatgtagatttggtcttttcacgtagtcccatatttcttggaggctttgttcgtttctttttactcttttttctctaaacttctcttcttgcttcatttcattcatttcatctccaattactgataccctttcttccagttgatcgaatcacctactgaagcttgtgcatttgtcacctagttctcgtgccatagttttcagctccatcaggtcatttaaggacttctctacactggttattctagttagccattcatctaatattttttcaagctttttagcttctttgcgttgggttcgaacttcctcctttagttcagagaagtttgatcatctgaagctttcttctctcaactcatcaaagtcattctccttccagctttgttccattgctggtgaggagctgcattcctttggaggggcagaggtgctctgatttttagaattttcagcttttcttctctattttttccccatctttgtggttttatctacctttggtctttgatgatggtgacatacagatggggttttggtgtggatgtcctttctgcttgtaagttttccttctaacagtcaggaccctcagctgcaggtctgttggagtttgttggaggtccactccagaccctgtttgcctgggtatcagcagcagaggctgcagaactgcgaatattgctgaacagcaaatgttcctgcctgatcgttcttctggaagctttgtctcagaggggtacccagctgtgtgaggtgtcagtctgcctctattcgggggggcggtgcctcccagttaggctacttgggggtcagggacccacttgaggaggcagtctgtccattcttagatctcaagcttcatgctgggagaaccactaccctcttcaaagctgtcagacagggacatttaagtttgcagaggtttttactgccttttgttgggctatgccctgcccccagaggtggagtccacagaggcaggcaggcctccttgagctatggtgggctccacccagttcgagcttcctggctgctttgtttacctactcaatcctcagcaatggcgggcacccctcccccagcctcgctgccaccttgcagttcaatctctgactgctatgctagcaatgagcaaggctctgtgggcatgggaccctctgagccaggcacgggatataatctcctggtgtgccgtttgcaaagacccttggaaaagcgcagtattagggtgggagtgacccgattttccaggtgccatctgtcaccccttcccttgggtaggaaagggaattccctgaccccttgcatttcccgggtgaggcgatgccttgccctgcttcagctcacactggtgggctgcacccacagtccagcccccactgtctgatgagccccagggagatgaacctcagttggaaatgcagaaatcacctgtcttctgcatcactcacgctgggagctgtagactggagctgtttatattcagccaccttggaaccccctagtagttaaatttttgaggagtcaaaagttatatatggattttcaactgtgcaggggagtcagcaccccaatctttgtgttgtttaggtgtcaactgcagtttaaaatcaagaagtgtgatgcctctagctttgttcttccgtctcaagattactttagctactttaattcttttgtggcttcacatacattttaagattgttttctctatttctgtgaaaaatgtcattggtattttgacagtgattacatcgagtctgtaaagcagtttgtgcagtatcaacatttcgacaacgttaattctttcaatccatggacatggaatatctttatttgtgtttacttcaatgtttttcatcaatgttttagttttcagtgtacaggtcttttaactccttggttaaacttccgcctattttattcttttcgattctattgtaaatgggattgttttcttaatttcatttttagtcagtttgttgttagtgcataataaatgcaactgatttctgtattctgtccctttactgaatttgttcagtagttctaaaagtttggtagaacttttgggttttatgtgtataagatattgccatctgcaaatagagacaatgttacttttacttttcaaatttggctgctttttatttcttctttttcttgactaattgctctggctggactttttcagcatgatgctaaatagaaatggtaagagtcacatctttgtcttgttcctgatcttagaagaaaagctttcagcttttactattgaagatggtattagctgtaggcttgccatagatggcctttattgagttggggtacattccttctatccctaatttgctgagagtttttattcatgaagtaatattgaattttgccaaatgttttaaagttttttctacatctattgggatgattacatgattttatcctttattctgttaacaacatgcataacctttactgatttgcatatgttaaatcatcttttcatcctggggtaaattccacttgacttttgttaatattttcttgaggattttgcgtctatgttcatctgacatattggcctttaattttttttttcttgtagtgctcttatttggcttttgtatcagaataatgttggcctcataaaatgagtttgaatatggtcctttctcttcaatttttaaaaagttttaggtggtgttaattttttaaatgtttggtagaatttcccagtgaaaccattttgtcctgggtttttcatttttgggaggtatttgattactgattcagtctctttgttatagggctgttcagattttccatcttttcatgattcagtcttggtaagttgtatgtttccagaagtttatcgattttttggttaaacaattttttggcataaaaattctcatagtagtctcttataatcccttgtatttctgtgttatcattgtaatgtctccttttatttataaatttacagttgggcacattggctcacacctgtaatcccagcactttgggaggctgaggtgggcaggtcacttgaggtcaggagttctagaccaccctggtcaacatggtgaaaccccgtctctactgaaaaaatgcaaaaaattagccagacgtggtggcacatgtctttagtcccagctactttggaagctgaggcaggggaattgcccgaacccaggaggtggaggttgcagtaagccaagatcacaccactgcattccagcctgggtgacagaatgagattccatctcaaaaaataataataaaataaataaataaataattttatttctttcttttttgagtcatatctcttttattcttggttagtctagctaaaattttgtcaatttttaaaatctggtcgatcaattttcattcatattttctatctttttaaatttcaatttcatttacttctgctctaatctttattatttacttctttctgttaactttgggcttagtatgatcttcttcttctggttccttgaggtgtaaagtataattgtttatttaagatatttctttttcttactgtaaacatttatcactatagacttccctcttggactgcttatgctgtttcttatactttttggcatgttgtatttccatttttgtcttaacatattttttgatttacctttttctgccttccttgacacattagttgttcaagaggttgttgtttaatttccacatatttctccatatttcaattgtcttcctattcttgatttctagtggcataccactgtgattataaaagatacttgatacgatttcaatcttcttaaatttgttgagacttgttttgtgacttaacttatttatcctaatgttccatgttcacttgagatgtttgttcagctgctgttggatatttacatatgttttgtatatgtctgttaggtccatctggtctaaagtgtagttcaagctcaatgtttcatttttctttttttggttttctgtctgagtaatctatccattgttcaaagtggtgtgttgaagtttcctattatacttgcattgctttctatttctctcttcatttctattattatttgttttatatatttaggtgctccatggtgggtacatactgatttacaattgttttatcttcttgatggattgacctctttataattatataataagcttttttgtgtcttgtgacagtttttgacttacagtctatttgggctgtcataagcatagctagctctgctctgtttgggtttccatttacatggaatatctttttccattccttcatttttaacctgtcagtattcttaaagctaaaatgattgtaagcagcatatagttgagtctcatttatttaatccactcggccgctcttgtattttgattaatttattccatatacattttaagtaattattcataggtaagaacttatttctgcaattttgttaattattttctaattattttgtagttcctttgtccctttcttcatctcttgctgtcttctttcgtgaattgattatttttttgtagtggtatactttgattcctttctctgtatcttttgtgcatctgctatataatttttttccctgagtttattgagttgtctgtgttctcttttatcttgctgagcttggttataataattgttttgagttattttcagttaataacaaaggaataacatttcatatatccccatttctttggagtcagttactgaaaaattattgtgttcctttgataatgtcatgttttcatttttttctatgcttctagtggctttgcattgatatcttcacatttgaagcagcagtcacctcttccttttgggttggcttcagtggaaaaagactgtcatctttggatggccacaagggtgccaactaaatgaggtgcaccacttccatttctgggttggggacagcagtgcagccgcctcgcaattccatcaatgtcaatgtgagcaaaggctgtgaaggtccttggcaaccaaggttgcagatgtcggtggtggttgcagctgcaagagttgttggggtccttggcaaagtctgctgggatttttctgttctcctctcccttatgggaaataattctagctgagggagtctctcttggtgttggatctgtcgtgctgatatgcatgcagctgtggtgttgctagaatccagggcatagacatactgtggcaacaatagtgcctgtgtgtgtagggtgcagacatcataaccaaggtcctaggcgcaggggcactcatggtggtaatggcacctgggtttagggtatagatgctcagagtggcaacagagctggacatgaggaactattgtgtcacctagggcctggggtgcagatgcacttgctgcattggtgatgctggtgtctgaggcagagttttatgcagattattcatgaagctggggtttggggtcttgagctacagggtgacttggctccaggggtcaggactcagcagcagcacaaacccagttatgataggacacagcctgggcctcaggggcacgatacagtggcaacacagctaaggagatggtaggttgccaccacaagacaggcccaagggtttgggacacagagcagtggcagtgcagccctagtgatggtgagccaaagccacaaattagaactcaggttggcagggcaacctcagtaatggtttgtcacagccaagactcagaccccatagaatgaggcacagaacagcagaaacacagtccctgtttcagcaagtcaaagtagtgacttagaacccaaggggcagagaacagaatggtggcagctccaactctgtagatgtcaaggagttatggtatcttgatcccaaagggcaaagcatatcagctagtgactcaggccccgagttaatgctcagtgcagcagcaggggatgcagcagtggctccttctctgggacagcaatgcagtatggactctgggaagctctgtgagctgggctcagcctaagtgaagactgggggaatcctcagtagcaaaggttgcaggtttctatggtattgatgtagattgctgaggtccttctgctccgctttttttcacaaggtgcaaatcctctgaggggggtccctcttggtgttgatctgctccactaagctaggggatggagtgaggcaggtaaaatgcttcctggactctaatatgcagctggccccagtttttttgcacccgtgggtttctactgctccttccttatagtctagaactttcttaaagaaattttcgttggtgcgcagttgtttttatttatttctttatttatttttgaggcggagtctcgctcagtcgcccaggctggagtgcagtggcgctatctcggctcactgcaagctctgcctcccgggttcacgccattctcctgcttcagcctcccgagtagctgggaatacaggcgcccgccactacgcccggctaatttttttgtatttttttagtagagacggggtttcaccgtgttagccaggatggtctcgatatcctgacctcgtgatccgcccctcccaaagtgctaggattacaagcgtgagccaccgctcccggccagttgtttgtatatttatttatttatttattttgtgggagggagacaggcatcatggcctcctagtctaccattttgctgatatcactcagtatgagattatttaaaatttgaatttgttcaatttacttgatatcaaataaatttgatatgctcatttaatagcttatttatgagttcctgccttgttagaaacatagttaatcactacgttttttgtggataatcagtttatagcaagtgaaaatagtttatttcctattcttatcatatgcctgagaatagggaagatgatttaacttctcttaccatgaataatgagagaagaggtaatactcttgagagaaataaactataattttagtgattgttttcctgaggaatttgtaaacatttaacagcattgttttttcttatgtattttctaactatttattgattattttgctttgtttcataaaaaataaaaatgagaaaaatatttctgcaggcagatgttagaaaggcaaattaacacttgcttttttacacggtttaaatactaattggaagacaatagagtcaaagaagtaagaatttatgggttaggtgccaagaaatgcttcaaaacgtaaatgcaaacatgtttttcagcatgaaagtagggaagagagaagtaaactcgtttatttcttcatttatctctttaagtcatcagaaaagaagaaaacaaatatgagctttcataattaataagaaatcacatttaaacaaattacactttctattaaaattattctctggtaatctattcatcaacatctcacaatttatatatgtagctgtttagatgattcagaaaatacggtagaagagagggatgctactctcacaaaatcctagagcaggattgcccttggggcaaagtagcagatggaagccaaaggacatcacagggactgttattgaagctcagagtcttcgaggagagcatttgggctttgagcagactgttggggaaagtgttcaggaaagtaagaaaaatgtcactggatgctggaggaaaggagaccttagttatgtacgtagtgccagaatgtttggcagcactatcacccgcagtaacttggacaatagaaaatgtactcaatgaatttttagatctatctagggagatttccaggtagtgtggtgaaggtaccttctggcctctctatgataaaatgtgagaggagaatggtaagtaacacaaaagactgccgctaaaatatcagagtaggaaacaatggctcagaatggaagtaatactccatttgaaatggttttgaattgagctatacccttgtaaacattattttgaacgtatttatccaggaacctaaataccacaagcatccaacaagagaatcgttctaaaagattgtaaaatattaacccatttttctcagtacaccattataatgaatgatggtgtatgtttgtaatgaaggtctgaaagttggaaaataatcagaggagccgctgagcccaggcaagatgtagataaaacagaatggctgactggtgtggcattaggagctctgactgataacgtgcaagttgagacagttctcggttctttatatatcataggctacaactactttaaacaataaggtaaaaaaaggtatatatgtaataatcctaatatgcctttttttcaatatttggaatctttagaggtaaaacatttaaactccaggtatatcactaatcatgacaggactacttcaggtaatcaatattatattaaatttaccataaacatttgttaacactattttgcattctgatgacatgtttgattgctaaatcaaacaagaaggaaaagatagcccacatgcactgagcaagaaatggttaagcagccagcttatgcatactacaacagctagggaaaatccttgctatgacttaggaatgaaggcaaaaacgcggagtcttttaaaacctggatgttattactttgttcccaaatccaagatgaccataaagacacctccccactactccctccccctctacaggagctcagtctgggaagaaggaagccaacctgaaggcattacacaactgcaggtttaaacggaaatgttcaagatccagaagccagtaacatcgaatgtgcaaattgattcttcagcctgaaattattttatataataatgaatggagtaacaaaatttggcccaaatttatttctgattctatagttagtcagaacctactaagtggtagacagtgaggaaaacaaaaatttgaaaaagtctgtttctgccctcaagatgcttacaggtagactttgtacaactccaatacaagtcagcctatgatagtataatattaaaacataaatatataacatgaaagtataaacatggcacaagaacattgaaaagtcattctacttggaggcatgggcgtttggagtttcagagaaagctgaaatgagaaggtggcatttgagtggttttaaaaagcacatagtaatttgggaagaaagataatgtgggagcaacgtaagcaaaaaataaaataaaataaaggtgtgaaaatacatgatagattcaaggaattatgagcagtctcacattttgatatggctacataaacgatggtcataacctttgaaagcaattgataaatatcctaaacaccatgttcataatgagtttggagtttggacttttatctggtgggcaatggaaagtaatagaagtattttaggcaaagtcatggcataatcagatctgtgtttggggaaaaatcaactgcactctccaatatggtagtgatgagctgcttgtggctatttaaacctaaatttaagttaattaaatttaaataaaatcaaaaactcagttcctaagttgtagtagccacaatttaagtgctcagggcagatatagagcatttttgtcattgtagaaagttctattaaacagtgcatatgtagagaatggaccagcgacatcaggcattagagggaataaaactaattaaggggcgagtattttcacagtcaccccaaaagataatgaagccctgctataggaggagtggtaatgggaatagaaactgagtagacagaggcaaaatcaatttataacttaaaggtgattgggggctaatagtgaaatttaattcatatgcctatcctctttaagagtacttatttaagaaacagatataagattcagaacaaaatattttctaaattactaaaataggggaattgggaaatgtggctttaatctggtgtcacaatcatatttttaatgcctgtattctaattctatattttggaagctgcaagaaaaaaaattgcaaatctaggggagtgtggtaggtaacctccgtggtggtccccagtgattcttccttcatggtatccacacttgcttagccctcttcctctttgaatagagctgacctgtgtaaccagtaaaatgtcatggaaataattgtgttaattctaatctggcaaagtcagaatggacgttaaagcttccatttttctcctgcttggatcaatcactcttgtggaagccagccatatagcaaggccactcagccctaaggagaaactgacatggcaagaaggcccccaccagcaacaactatgaacttaaccagcatgtgtaaactccaaggagttggaaacagattccccagccccagccaagccttcagatgactgcagccctggctgacatcttgactgtaatcttatgataaacactgaaacagaatatgagccaagatacctagttaagctatccctataattctgaccccatataaaccgtgtaatattataaatgtttattgttttaaactgctaagttgtggagtaaattttttgcaccaatagatgtagggagttgtttcttagacagctgatccttcatccaaagatgtaaggaaacaagacagacatctacatgacttttgaccgtattcattccatacagtcaagatatgtggaccagtgaactttaaaatttcactattcacattgctgcaataagtcagccctctcatgaagaccttaggtatgaagtttgctagtatattctaagagaaatctcttatagaagcatgagaacaacttcctaaacatcagtgaccggttatagaacataagacagagcaatgagtctaagatgactttggataaagcctacactgagacagagatgggctttgcaatggagcttctgttgagtttcctttttcatattcaagcaaagaatgtggaagaagtgtagtgcacatttcaggaactttggattataagcttattatcattttgacttctgctcatgtatttgctttaatcatattttatatttctaaccagagtatcagttacagacatattattttcattaatttactcaaaacatttaatttaatgttagaaatgcttgagaaacattgtcacaattttgcttcctcttactataacagatatttgctttaattagtttttactttgattgtacaaacttagtgccaaaagcacatagcagttgatatgtcattggaatagaatataaattctagtaataaaaataataaaagaatttaaaaatcacatcatagacatttcaagtgaagttattataaaccaaggacttcaatagcaaccattcctggagcccctgtgttaaattttttcctttaaactagcatcatttaattctctgaaagaaaatttaattttgggtttctgttacaatgataatctagaaaattaagacatgcatacattgaatcatatagctgaccatgttaacctgagtgtggccactcaagttcaattcccatgtttgtacgtgtctacagtcccattgacactaactgaaggccaaataatgttgcagtttgccatataaatttttaaaaataacaatattttgaacgtagaaaagtgatgagaggattagataattgtaggataattattattacttatagcattattattattaaataattgtaattgtagagagaaaaattgacaagtcaaattttaaaaaataaacaataaccctatattgtggctttaggtgccatatttgagctctaaactggcatatggggaagaccctgtttgctgaatttgcaaacattcatttgcagtaaggatagtggtaaatgaagtgtgaaaaacgtttccatttaggttacagaaataattgatttagatatccatttaatgttgatttcagtaacactcaatttcaccccaacctcaagtaaacaatatagttgaacagagctatcaagaactaccttgttaaaatgacatgtagaataatattgagtctttacatttccctttatgactgttcttttcatttataaatgactaatagaataaccatcattttatacaggaaataatgtgcctatagaactaggttttttagaggattgagtagtggtatgccaaacacagtagaaaatgttatgaaatatacttttttatttgttaagtcatgtaagttatttgccatatgtaaactttcagattaataaattttttaacttagtcattctaattttttccttgtatcttaagccttcctcttttttgcctcaaaatcacagtgtactggtgtaaattctctaggcatagacttaataatcacagaaaaggtacatacataatgtaatatgtttgtttagggctcaatatgtcatttcagtttttgtgtttctcctcacacctatactggtactgaaaggatgcaacagagtcatcagcaaatatacaacttcatatcaactaaaggtactttacacaagagaagagactccaaggcaacagatttcctatagcagtcttttcctaagagtactaaggtaattagcctcaacaggagataatttcggttcacaggggttgctgttgttttaagtgtttctgggaaaattggattttccattgatagcagttttaacatgtcacactggagccagagtgaattaaactgaagagctacacagtctaaacaaacattccttcccattatcagaagcctgacaacataatagcataaactatagtcatgtggtcacattcacaagtaatgcagaaacaattaaaaatcaaagaaatgctacattttgtaaagcagacttagttgaggtaagcatgtttaaaattattacttttccttcctcccctacaagttttatattgtgctttaaagttgaaaaaaaaatagcaatgtttgtttgaatcacgattagtgattagaaaatccaaatctctctagcctgtgttttgtaataccaaagtagaccgtggtaccattgcaacataattcaagtatttaaactttgaaaacactgctgatttgacatgcttattttttaatatttttctgttttacaaaaattgcacaaattactgaaataaatttggagctgtaattccactatgtgttacctttcctcaaagacgttaatcaaatttggttatatttacacatgtaatggatgatatagtttacatgtcaaaagtagggtgcatttatagataatttttcttaatttcataactaagagatttttaaaaactcataaaaattgatagaattacacttcagtaggctctgaaatgaaaacattttgtcaataattttgaaattataatattactttcctacatttagatgacttgtgaagataataaaaaattatcaaaatgcttttggctacagaatgtttgtgtcataaaatagtaacagatttttaactgttattcaaggaaggttgtactaattatatttcagaaaatcgttgagacttagactttctctctgcatgcgtgtgtacatgagagaaagaacttgccttcatgtgatttgagcttggtaaccgcatatctaacactttccaagacccacattgtcaagtactccattcgcataggtagattcaaatttactgaaccttgttgtttttattcagaaaaggaaataaatcaactatcatgatattaaaacatcttcaagtgaggctttgttatttcttctgtatcagttctctaagtagtggtgtggagaactcactttactcttaacttcatcttgatttgatgtctcttttcaacaactgaacattcttctgaattcagggatcgagatcgagtggtaagtgagcagggaataccaagatgcaccaaaattaatagtggtaggaattcaattccacttaatttaaaaatacctattgtaaaaattgctaggcactctaaaggatataataattgcaaatagtcactcaatccttagggaacatacaagaagtgaggagataaactatagaaataatctacacaaggtacagtgtgaaaatactttttaaaaaagtgctgggagaacaataaaaaagataagttctgaaagtatcctcagaccagtgattcccaggccaggccacacatgagaaatagctaggaaaatctttataaaaattgaaattagtactttcctggacccaccggttaagcacttttggggggtaaaaactgagcatatatattttttaaaacctctcctgataattctgaagtacaatcagatttgaaaacactagtccacactatctaagcataagctagttacaaaatcttatgtaaatatatccgtagctctcttaattattttctaaatggggctccctcatatggaactgacccttccaaacttaacttccacttgcaaaattcaaaacatcctccaagtagttccacccagcttcaatactttgtttcctcagaccacattcagaatttaatacaaacatcaaatatttgttgacatatatttccttttttgcatacattcttagtgatctattcacatgacttatcttgactacaccatgatttcaggtagtggattgtataaattttttcttgtagttagaaaatgtatatatatgcatccatgcatgcaaacacatccatgtatgctgtatatacattttgcacatcttcccacatcagcctagtcttgtgtttggtctgttgtagtgttgagtatcttattgacaaaaaaacattaagaaactgctcttcctgagcgtgttcccaaacattttagtaataatactgttgacccttgaacacaagggggttaggggagccaaggccccacacaatgcaaggaaaccttgcatataacttttgactctctgctatagtttggacatttgacccatctaaatctcatgctaaaatttgacttccaatgttagaggtggggcctaatttgggtcatggggatggatgccttattaatagattaacgcagtggggtggaggtgagtgttctcactcttcagttcctgcaggagctggttgttacaaagagcctggcacttctcctcacctacttgtttcctctcttgccaagcgatctctgcacatgctgactctgcttcatagcagcctgaggcctcaccagaagcaggtgctggtaccatgcttcttgtacaacctgcaaaaccatgagccagataaacttcttttctgtataaatcacccagtctcacatattcatagcaacacaaatggactctactgttgactggaagcctcaatgataatataaacagttgattaacacatattttgtatgttgcatgcattatatgctgtattcttaccgtaaaataagctagaaaagaaaatgttattaagaaaatcataaggaagagaaaatatatttactattcattaagtgaaagtgaatcatcagaaaggtcttcatccttgtcatcttcacattgagaaggctgaggtggaggaggaagagaagggactagtcttgctttcttcagtgtggcagaggcaaaagaaaatccacatataaatggacatagacagctcagattcacattgttcaagggttaactataactccccaccacccaaagcaattctgaatgtgaatgatttactttacttatattatacttgtcaaacgtttgggctatttaaaccaaattccctgaaatgttaatggtgaagaggagtgagaccaattcccaacatttagcaaatcatttttgggcataagacgggtgtggaacccagggattggagagaagatagcaaacagaaggggagagaagcaggggatgtgaggattcagcagaaaaggatcatggctgctttcatggattccacatctttctcccccactcaacagtctatagacctcacttttgaattctggtttctcattttattataatagttttacaatctgttattttacaccaagatttttccttctagtataatatctgctaaaatgtgaagcttattttttaaaatttgctcagatttggtatttcctgctctctcagaatacactatttctgctaacctgtgtaaactgtatagtaataataaagaaagaggctgggtgtggtggctcaagagacaaactccatcaaaggaagaaagaaaggaaagaaagaaagaaggaaagaaagaaagaaagaaagaaagaaagaaagagagaaagagagagagaaagaaagagaaggaaagagaaagagaaagaaggaaggaaggaaggaaggaaggaaggaaggaaggaaggaaggaaggaaggaagagcttccagagaattgttaagtataatatactttttcattaatgcatatgtatggccaaatggcaatgccagttcacagaaaatagcaacattttatatctttaaggtcgttagacaaatggatataaaatgtttctgacagtgtcactgagttcaacaagctagattggagaaagagaaacataccaagagctccccgtgggaaataaatttatctccttgtgttaacaacaacaacaacaaatcctatgaggcagctgaatgggctatggaaagaacagagtggaatgctggcactgtgttcttttcattgaaaaccattatgcagagcccattaaattcttcctaaggagaaccttctgcctggctaaacttgagtttaatcgtaccatgcttccagaccatgcagatttctgatccaaaacaattttgttcccagcccataacacaattaaacacccctctgcatcaaggcacaggaaaaaagtacccacgatgcaatggagattacattctgtaaaaattcactagccaaggaagaatagtgccaatggaaagttgaacattaaaatagttcaaaaggtgaattgggtgttgctggaatatactgtagggctctcagtttccaatagtcaccctgggtaaataacattaactgggttgaccatagtctcaagctcatttaattttattttagcagttattttaggttttcccctaaatgctgtgtacataggaaaaaaatatgttactttgtgtattgactgatttcataaagtatttctttttttcccattcagctcattaggagaaattttttaaaaaaacggaagttaagcatcagctcaggaaaagtatttacagatttaatagtcatttgacaaatattcagccaacatatatttaccaagaattggctatgtctaatcccgctttaaagattacaaaataatgcaaagctagattatgtggtccttgtccctaaaaagttttcaatcccaccaaggaaatacataacctgaaaaaattcatgtgataaaagattgcttgaaggataagatgaattggcttctatctgctaactgtgttttgggggacaccataggataacatccctctaccagttggcgttgatgaaatgggatgaacttgaactccatttagcttaaatctccatttaacactggtttcttcatgcaaatcattcaacattctcttgatgtccatttccttagcagctaaatggaaatgatatcttctctcatacataaaatttatggtgagattaaaaggtgaaataacacatgtaaaaatgatttttatttttaatcatatagcttaatttggagcctagttttgtttgctacgtacaaggcggtgtgctaagtgattagcagatgttgtgccatccatattcaagaaaatcttttgaatcttacatattgtgcataaacctcagtatttttcctgtctaaaagatgaggaaaccgaagcttaaggaagttaagtgaaacatgccaatatcccactgtagtaaggggaagtgttcaaaacctaggtttttctgagtccagagaaccctcttaaccagtatgctatattgtcatcttttttgtgcaaaagtagcaattgatttctaaagtatgtgttattaacttcttctctgaaattcctacactcactgctaatgatccatattgtgaagtctgtacaatgtcactattaaaatgtccagactaagtgcaggaggagactagggttggtattctagccttcttctgtttggagaatagtttctcaaattgtataatgttggaagtaacagaaaagatggtattgaggtgatggagcatgtgacctaagtgatctgagaaagtgatagaaaaagaagttggcattcacaggtccccgagacaggccccaaacaagatctgtcggacgaatgtataggccttgggtgtcagtcttggactttaagagaactctgtgcagagatggaatgcaaagaatgtacatgaagaagatagataaatgcataaagtaagtgatcctctagtgatcagaaacattttccttcactgtccctatattgcctcttaatttctggccttgaccttgttattaattgggcagagtggattatagagaagacaacaatgggaaaagtagctaagagcaacatcactcctttggactagattgaagctatgcaaaatgattttcaataaaaccctctctgctcagttttaaaaggtacaatcgtacgttcacataaaattggcttgtgcataaagaagagatgggttataatatttgtatatagtaaataactatattttgagatctttacaattataaaggtattctagcagaataatttgtataaagtagcttaagtaataatggcatttcaattaaaccttgaatgggttcctctacagaaatttctaaatatggggtataattttgatctgacattcagcccattgtaggatttacattaaattgtgaaccactagaaaataggagagtatctccttttagttttgtgcaatgcttagtgcacctagagatcttagtgggtttttttttaaagcaagtactagtttggctaatgaaaaattatttttaaaagatatgtcaactagacatctccagtgtgccatgcccaagattgtattcttgatcttcttgccaaatatgttcttcccatagtcttctacatcttagtaaatgacacattttgctcaggccaaaagccttagaaccatccttaactcttctttttgtctcccatccacatctgatccatcagcaaatcttatgaatgtctatttgttagggtataggctcagttgctctaataaggagatcacaaaatagaggctaacaaccttagaggtttgttcttcctcacgtaagagttcagggaagatggtagtcagtgctccatgacggggacagatctgcctccctcaaaacattccaagtgccctggtttctagaaagaaagaaggaaaaaggagaagcaaatgcagggcaattatcattaggaagatagcttggagtctgcacacatctcttctacttacatctcactggtgagaacctagtcatatggacaatctttgctacaaaggacgcttggaaatgtagtctctagctgggcacccatatgaccaagaggaaggggtgaacagattatggaagacagcctatgatctctgtcacaggtttgtatttccaaaatatatctagtctctaattacttatcacctcatcacccccatcatcacactactagaagccccaattgttcaccattgcaatatcctcctaactggcgtttctgcttctgttcttgcttccctaaatgtattcacaactgcctgtgatgatgttaaaacacatctgaccaagacattttttctgcccttagtcctgcaataacttctcatctcattatgagtaagagctcatggtctagcctctgctacttcttgacctgaacttctactcataccaggggctgcttgttggttccaacatgtcctgttatgcttcttcctcccggaactcacagccatgcaatctaacatcctcttcttccagctctcccccaggctcactcctcagcttcaggtcctgattcaaatggctccttcctggcaaggccttgcctggacaccctatttaaaactgcagctcttccatcacttgagactctagctcctttgcctgttttatttttctccttggctccttctgtcatactgtatattttacttatttgtcttgtttcttctcccctgccaccgccagtttactccccaaccccagaaggttcactccaagatagcagatgtttttgcctgttttgttcttagcatcttatatagcatctgaccccatagtagttgctcaataaatacatttaaggaaattatagagagaataaatgtgtcagtaaacctcagccatctgattttccatttaaagcacaaccttggtatagatatctggaaattaaggaaacaatctgataataataattaatgtgaagctataagaccaggaactatgaatgagctatggaagaaatctcagacttgaaattggaagatttaaatttaattgccattttgagactaacctatttatgaaatttaacgattagcttcctctctttcggcctcagttttctcagctaagtaaagcataaatatgcacttcagaggtatttggaagctgaaagatgtgaaaaagacaatgccatatctgaaagtggtcgcatatatttattcttaagtttacaacatttattaaaataggaatatcatgggatttactaatttcaagaagttcatctgggtcctttggataaaacagtctttttctgttttatgtttcagattctaaccctaaggttgtgttgaacctcaaagatgccttgaatatatttagtaaaataactacagtaatagtaactagaaactttctgtatgtagttaagtattttcatataagttattgcattaaatcttcataaaagccctataagtacctacagaaacatatgattgttgcaggctttattaattacaattataataaaatgaaatttaaaaatacttcaatgttggcactaaggtacaattaaaaaaaattgtttaaacataaaatcagtatttttttcctgaaatgggtggttacttacatggtaacttttctccattaatctattatttcctcaagttcaaccaacaaagaatgtcataaattttaaaagtaaaaagcaatttctttcaaaataattccctctcttacactatgataaaagtgcatgggaaacattactaaatcaaaattaactgctccagtgtcctgcctaaattagaaaaaaaaagaacatgtatttctgtgcatgttaactacacatagccccattaataattttttgtatagaatttataagcgcagcgaacttagaaaaattaagcaaatcatagagaaaatgacagagtttggaaatatcaaggaaccagcccagattctctgctaatttagtttcgggacatgagaatagtgcttttttatctcagacttggctcaagcttggggaaaaacatttccccaggaaattttagcccagctgaagcaattgatttttactgcttgtacccagcatcctcatttttcagcgctactcaatgcacaaccactcagccatacacattcggatggttattcagaattgaatcaacaactttgacagagtcaatatctctgctggcctgtaacaaaatggccttgttattccagaagatggacaagaaccagattagacatcccagtttcctagctacagaaatttagacaatcaaaaacagtgttggaatatccagtgtttcttaagataccatggagggagcacatgcttcaaaaagggcatggtgcaattcttcaagaggataaaatgtatcatattctaaaaaatacctttaaaaatggacaactcaaacttcctgttattttatggatgagtctggacacactcacaaaacctttttctacaaaattttcagtttatcggccacagtggtggccataataaaattcttgacagtattacttttaacgcaaacaacagataacttcaactgattgaaataaaaatgtaaaagctccctggatgttaaaagaataactgaatggctccttgcaaatcttctacctagataaattttgttctgaatatggaagttttagtatcaccattactttcattaagttttataatggtagctaagataagtctagctcagaaaatgccagagtgttttaggtttaaagggtcacttccttaatagattggggttgtgtcagatctactttaaaatgagatagtacatataaaaatactttgaaaagttaaaagcatcacataaaagcaggacctttcttagatggaaaccctgttttggaagcacttaactataattgcaaatgctgataaatgaaaaaataggtcaccaaaaatgctttcataggcgttttcttccccagtgcaagtgcattcactgatgagaagaatctatgccatgcggtaacacagcaagaccatttaaatacctatcatgtaataagtaatcaaatccgagggctcccttgggcttttagctccaggatgaatttttccccaccctttttggccctgtgtaaatgtaattttgttttaataatgtttttaaattatggttgtctaataaacataattttaaaaattgtccttcaaaaaggactcacttttcaagactactttgtaaaccagtaagcttctcctgacttgttctcctcgaagggtctggatggtttcatttacttcttcacttttataggaaaaacaatgtaaaaaatttttattatcgatagagcattaagaaacaacttcatgcaaaacaattagtctggccttaggttgtgccctgtaaagctgttagatagctctatctccctctactggcaaagtcagcatcccagattctgagttccttgacccaaagaatgtcacccccagaaacaaacaagaaaacaaacgagagctgcttccacaattagccctaagccagacaagactgggaattttcttcccatcttacaaagaaaaaggattaccatgaataagcagtgttcagaggaaaaatgggaactattttccttaaacattaaaaaaagtaccaagaagattcttggaggttaaaatgcaagtgcacaatgatccgtgtgcagagaatgtgactttttttccaggataaataaaaaagaactaaacaatttgtagaatgcagtcacatcaaatctgatggtggagaatgtgtgtacattttttaaaaaatcaaataccttaccttcttgataaatggctcataagggcactactaccaggagtcgctgaaggcagaacccgagcttaggtattttaagtggcattacatgttctcttcaagttcatagggttaaacaggtaagtggtttcacatgtggttccttcctaaaaaatgaggacaataatgatgagctagccacttttttagaggtggaaaaaaactagttagaatccacgctctctggagacagagttctgcagtaagtggaaccttctgacgatggagcctggagccagcagctgggttctgtcaccctgactggggcggccctgttagtgtagcgtgacccctggcgcattcgcacagataataccggcacctcttttcactctaatctcctacccgtctgagcaattcagcaggagataggggcattaaggccgtattattccaaacaacatttagctgaatggtagctgaagattgtgacagcaaaagacaaattctcctggtcaaatactttccttcccagaaaaccttcctgtttcagtacttttgagacacaaaaatgtcattaaaatggaaccaaagcgggaatcccacaccatccttagctgaacctaggaaaactttgaaattccaaacagaatttcttggagtttctcatgctacaatggcctgtgataaataacaccaaatagccagataaagaaggaatcatttattcatgtatttgcatattttgttgacattatgccatatctccagatatggctgttgttcacaagtgagcagagttccagggagagatgtacagatagcctgtttttgtaatatgtatctaaatacttggtggcatgtagccaatcttcctggaaggagatggtgttataagcccataacctaggtcagaactctaaatgccaatggcagagtgttgctttttatgttggtgatacaacatcgtctgcatttagatagctgataatgtgttttctcaaagctgaaggggcaaaagtaaaaactttcttaaatgtttacagataattttagtgctataactgtaggctaacattactttgtttttcaaagtgggaatctaagtaaattaatatttaatatatattcaggaaattaacagcactcttcctggttgctttttctatttctgttgtttttcctttcaaaatatacaacaacaggattttgctgtgatgttctaataatttaatttgggttttaaaattctagcaatgggacttatgggaaaaaataaactatctctccggtaatctgcaatgcctggtgctctgaaataagatcagacagtgatcagagatgattctttcctgtgacagggcactgtgttttggcaaaagctgattattctcttagttttgtctgtgcagaacatgaggttgcttatgtgcgaaaagttgctgggttgctacagccaagacgtctcacactttgaggtccacaatggttattaattaagaataataaaaataatgtttaaaatctccttctggaaaaatatgcgtatttcatacttaacaggaagtgaatacagcaatgaagagctgttttacatatcttttaaacaataatgaaagacttgtttaataataaagattggaattcctactttgaatagcatattatatagcactataattcatacttcatctgagaaaaatatatttcctgcgtgtcagccaaaataggttcatttgatgttgttctgttgatcaaaggaagtaggctcactttgtgggcatgtacgaacatcatgtcatggttaaaacatagccaaatagggttgtgggaagagctagattaaaaaataggcaaatgaagcaatctgtccaggtcactgagctacataaatcactagaataaataataaatatgatgccaggaaactaggttttctgcagaacactttgtacataactgataaactgtaacttggtccctctcataatgaaaataaaaaacatttcttgcctttgtccacaacagtctatttcttgatgagtatttaattttggctgtgattcgcaagacagcgtagagttccagggagagttcactaaaattcagaaacaatacaagactttactggaaaagtgatttattacattattgaaataattatttaaaatttcaattgtttaatatactccttaaaaaattgtttatcccaaagcattgcaaatgcaaattgaaaaataaagaaatgcagataaatgagatgatttaacgggcatgaaagccgggagaaaacaagcatttacattattttgaactaaactttctaattacacctatgcaagctgtagcaaatgatggaaaagtgtaaataaaagacaacttcccaactcttaaaatatctttttaatggagtaacaaaaaccaattacagcagcaacggcaaaaagcaatcataggaatatatttaacaataaatattcacagaagaaaactatactattggaagtaaaagtattcatgacaacaggaaagacattccctattctagcattggatgtctcaataggatgatgccagttctccattaattaatttatacatttactgtaatcccaataaaaataccagtgactttctttttaacagagctaggcaatttggtacttaaattcatgtgaaacaataaacacagatgactagctagaaaaacactgagaagaaaggcaattaattagcaggggctaggcctacaaaataagagaacatactacaaagcattttaatcaaaacagtgtgatgcttgtgtgtgaacggctaaaagaccaacacaacagaataataatccagagatagtcccgctatatatggagatctagtgtatggtaacggtgcttttcaagtgactgaggtaaaaaattttttgtctcatttttaataaatttattgggacaactagatggccacttgggaaaaaataaaattagattcagcttttgcatcaaataaatcagagatgtggaagtaaacatgaattatacaggcactacaagagagcatcagtaaattcttctctgggtgaagaaaaactttctaagtataattgaaaatccagattcaccaaaggaaactacgataagttgtactatataaatttataaatttcatggcaaaaaataagaaagctaaatattataaacaaattcaaaagacaaataacaaactaggaaaaaatacctacagtatatatgacagagaaggccaatttctgtaatattcaaagaacttacaaaatttgaagaaaagaacaacaaaaatcctataggggaaaaaaagatcaaattgtcatgaacatagaagtcacagaaagagatataaaaatagcccttaaatatatgaaaagatgttcaactttactcatgttagaaaaattcatattaaacttcagtgaaacactatttctcacctgttagtttggcaaaaagtcaaaacctgactgtatacttttttgatgatgacattgggaaactgaagttctcatacattgccagtgggaactcaaaatggctcaatctttataaagtggaatttgcaaaattactcattcatttaacattctaggaatttaccataaagacaaacctctaattatatgaaatatgtgtatgcatatgtatatgcatatatatatggttatctattgtagcaattgtaattgtgaaacactggaaattacatagatgtcctccaagcctaggagttggtttaattaaccatattacaaacactcaaaggagtactatgcagttgtgaaaagcaaaaaagatcttcatgaacttatatgtagtgattactagaagacattgtgaagtgcaaagtgaaaagtgcaaacaagcgtatgtagtatgctaccttttgtagaagaaacaagagaaagtaagatacatatatcatttatctttaaaaacaacacacacacacacacacacgaagtgtaaaccaacaaacaaaagcttttattatctatagggtcagggaagaaatgagattaaggggctacagaaaggaaaggtgtgataattctttgggtatacatttttaaaataattttgaattttttggagcatgctaatgtttttggaaatcaaaaagtaaaattaagtcagcaagggtgagaagaaaattcctagtatcaaagcaaatagaaacaaatggactagaatgtatttcaaatgaatgacatactcactttatgggggggtgtgaaaaactaatctaagtaattaatggtatttgactatataccctcagtcttgggcagagtcaaggtaggagagacaactacaaacagattctgagttccttttagtagaaatttttggttatttgtagtgatataagagaagcaattctgaaactattggatatgttaaagaattaagcaaataagcaaatgtgtttatgttgggagccagagatctcaaatggaagaagggacatacaaacaagaaacaggggatggcaagaaccttgtgaggattcatgatttctaaaacatttacatatgcatatagctattatgtgtatgtgcatatatatatgtacacacatatacacatacacatatacacacatatacacacatatacacacataatgcacacatatctatgcctacgtgtgtaaacatatgtgtgtaaatacatatgaataggtatgcctgtatatgtatatgtgtaaataaatgcaaatctcttaattttcctagaaggaatgagcaaactttgtctctaatgcctcttgagaaatgtttgattccagaactgaggcagggtgagaaaattattattgtaaagactaggtcgggcaaaaatcaccaatgggagctaaatcaaaggggcaaatttgataaagagcaggatatttgcatggacttgaaagtgtgacttataaatttctacttcttgaaaggagaaaaagtaatagctatacaatggagagggcaggcaacaccctgatcggatgataaaagttaacagtatcaatgggaggcagatggacatgatgccctgagaggaatatggcttctacgcagtattctgactgaggcttctctaacttcagttaaataatgaagaaacattagacaggtacaaaatgaggagttctcaatctttcttttctttctttctttctttcttttgagacagtctcactctcaatctttcttttcttctctttctttctttcttttgagacagtctcactctcaatctttcttttttcttttcttttctttctttctttctttctctctcccttccttccttccttccttccttccttccttccttccttccttccttccttctttctctctctctctctttctttctttctttttctttctttctttcttttgaaacagtctcactctcgcccaggctggagtgcagtgccgcaatctcggttcactgtagcttcgacctcacaggttccagcaattctcccatttagcctccctagtggcagggaccacagatggctgccagcatgcctacctaatttttgtatttttttttttttttataaagacagggtcttgccacgctgccctggctggtctcaaactgctgagctccagctatctgcccacttcagcctcccaaattgctgggattacaggtgtgagccaccacacctggccagagagctccattaaaaacaaacaaacaaacaaataaaactgagggactagttttcaaaactgtcgatgtcataaaggacaaaaaaacaatgtggaaatgttccaatttaaagatgttaaaggaatatgacaactacatgccatccagatcctagagtggatcccaaactagaacaaagataacgttatatagaacataattagatcaattgatggaattggaatatagatgagagattaaagttaaatgtattgaagttgataaatatacatggttatgtaaataaatatccctattcttaaaaggatatttttattcttaaaaaatatgctctgaagtattaggggtaaagggtcataatgtatgaaatttactctcaaatagttcagaaaaaatatgtaaatagaaagatggatggattagataggtagattagatagattagataggtgggtaggtatttaggtaggtaggtagtaagcaaatgataaagtaaaagcaaataaggctaagtgttaagaatgagtaaatgtgggtaaagactaaataagcattctgtatatgattctttctcttgcaacttttcttgaagtttgaattatttccaaattaaaagtttttagaaaacaaagcatctatagaccgtatgtgtaataaatataaatacattattttgaatataaacatctgaaaattttaattaacaaaacttggtttatttccccttccactaaacaaatattggacaaatattcagcaaatgttagtctgagggatacccaaatattggcctacctggagtccacatccagtgtagccttggatataggcagatgtgtgaactaggctaagtttctcttgatatcaattatatatctgggaaattagaacacaaaaccaacagaaataaaattttggacttattcttaccaacaacaaaacttgcctggttatcaaaaaggaaatgttaaaatctctgaaaaataaaaacaataaggttatcttagagtgtttgatagccagtaagtgaaaatgtgaaggtagttaaacttggtgtctgctatggtctgaatgtttgagttcccctaaaattcatacattaaaatcctgacactcaagatgatggtattgagaggtagggcctttgagagatgattaggtcatgagagcagagcctcatggctgagattagtgcccatatacaagagaccccagagagctagctctcccattccatcatttgcgaactcagctagaaggcatatctaggaaaaagaaacaggccttcttcagatgccaagatccattaatgttgtaagtcccaacctccagaactgtaagaaataaatttctaacctttaagccacttagtcatgatattttgttgcgacagccagaacagactcatacggtatccaaagttttaggaaagcagagttccaaaagaattcagagaagaaaatagacttgatatcaaaacatgaatttctggaagagagtctaaaacattttagaagccatgaagatctcatcagtgcaattctaggtgacgcagaataaaaagggaagtacacataaggtaggattacaatgtgtgatcatttatgacctcaaaatttttaaatataagcataaaagttaaacaatgagacatgtagcaaaggatagatggaatagagtggtgaggacatgtaaaaataatatcatcaagaccatggccccaatgaaatgaggcttgcccatccaccctaaaacactactaaagaaaacatatttcttctgctgttatttttgttgttgttgttataacaaaaaattaaagcaacagaggacactttccttagccttggaagtgaaagataacacatttcctgggctgaattttattttaaaagttttaaaacataagagggtcaagacggctttctaccaactgtctgttgcctacaagaggcacacttcacctataaagacatagactaaaaacacacgtagacacacataaagggatgaataaagatattccatgcaaatggaaaacaaaaaagagccagaatagctatacttatatcagataaacagatttcaagacaaaaactatagtatagtatagtactgaaagtatcattttttataaggaatcaatcttggtaaataacttcatttcggggtatgtcagagcccgattcactacatgcttgtttatgaatagcaagcaaatgaatagtccctttaataactaaagaagcaactgacatcatcatatttcattcaacaaatactaattgagagactgacgagtaacaggcaggctttgacctaaggctgggaacatattagactgtctctctagcttcagagaggacttagtctaaagggagaaatgacaataaagaaatatgctaatagacatagctttggcaggaagtggtaagtgtgctaaaaaaaaaaaataacgcaggagagattaaacaactggtacatatgtgggagtattcaagtaattccactccaaggaagtcacatttgagctgcgacttgagtgaaggaaaaggggaagtcctgtaccccataacagcagatgtcaagatggagaagtgctttggtgttcaagaattgcaaggaagccagtgtgctggaattcagaaagatgaggcccaagagatagccagggccaggtcatggtggttctcgtgggccacagtaaggaatttggattttattctaagtgtgacagctagttgttggagcagagaagtgacttacgtttaaaaagaccacaaagtgtccttttgaatcctacaacccttcttgatcaattcctttgtgggagaaaatttactgtgattcttttgcatttctatacaccttacaagcagaaggacatgctgcttgtgttgcagttatctgttctaaggatgtttgtatagtgaacaacttgggtgacagacagaggaagagatactgtcctcttctagagcaagtgttcctctcctgtaacaaaacaccctgcatgttatagtcattacctgacactcttcaagtaacactgtgggactcagagctcaggaaaccagagcattttctgactactgctatagctctaatgaagtctttggtttccaacaccacaaaattttgtatttttccagcttccatgaaactgtggtaggcaaacttgttagcttacaagtcaagtcaagtctcatatccttcacagttcttgatagctttggcaacaggaatgacctgacagacatgactttctagaaaaatgaagacgaaggtttctcaggcttattagtaggaattgaaggatgtccgtgggaatccgtagtgaacatgttgaccaaattgtatggttaacttggcaataaatggtatcttcctcgtcattgcttgttaatgaggaggaattggggaggtggctatggattgagtactgggaagtaggtttaaagatggtatccgtgtggtgccatagttgttgttaactccccttcatggagaaggctgaaactcaccaccaagctatctgtgtgccacggatttgccctattgcaaagactagaactagtcatcttaggtgggcagaagtgtccacctgccaacagacaacagttacatagataagcacttacaatcattgtaaaatgaggaaagttcataaccactaagggcagaagccaggcaggtcttagaactttggtggtgcatgtggagtatgagggaggcgatatataacattcaaggaagactggcaacagctgggtcatcttatggctcaactccttttggagtctaacaggccagcctcacatcttttcagaaagtaaagtgaaagatctcagttgttctttgtttgtttttgcagtgagtcttagctgttataagggagctttggcctcctgaggaaagcaaccaaactccagtggcaagccatagatgaggtattaatgaacatttgggctcactgtgactataaagattttttttccataagacccataaaccacctattgaaatataactttccattaaatccttcaaaataaattggttgtaaaatgtattgctagataacagaacctccaaattccagatccccattctacagtccaggagaacatcttccttttcctgaaaacagcgtctcggtcaccttgcatttgccttgccaacatcatcaagactgtgtgctaaatagtttcttagagatgctagcaataggccagttaaatgttaggggccattgaagaaaaattatgactctggttttgaaagagttgatccagaagttttctttcataaagaaatatgctagcagggccagttatcttttgaggctagtcttagtttattataaagcaaccatatcatccttatagttcttcattgtcttatgatgtgggatgggaggaacaggaatacacagtgctcttgatgtctactgaggtaatgcacccatctgtctgatggttaatgtgaaggacaaagcttgacctaatactgcagtctgcaggttgtggtttctgtgatgtggaacaggcagggaagggttcatcagactcacctgctgcacaccacagtttgtagagaggtccaaagtgaggtcgcagtctgcctttttggtaaagcctgttggggaaaacaactaaaccaatggactcttgaagctatgttgagcaatccaatatatattatggtcaataaataataatatttattataatcaataattatttctcctggtgtcctgctcacttgccaggctaaacgaagggagaaactttctcatgctgctgatgctgactgcttttggataactctttcatactgaactggactgctgcgttcttgaaaaaccaggaagaagaaaatcaccctctaaaactgaaatttccagagacttgcctcaacccattggctctctacatgctgccctcctattaggaaatagatttgttacttacattcccccctccactcaccctccactaccagacaaagctaaatgggctcaggggaaataagtaactgtgatgttcctcagagatctgttatgtaccaatgataaatggaaaatgaaaattactaacatttatgattgatctatatgtttgtttttgttttgttttgttttgtttttgttttgttttgttttgtttttgagacagagtctcactctgttttccaggctggagtgcagtgacactaccttggctcactgcaacctctgcctccctggttcaaaccattcacccacctcagcctcctgagtagctgggattacaggctcatgccaccacacccagctaatttttgtatttttagtagaaacaggtttccaccatgttggccaggctggtcttgaactcctaaccgcaggtgatctgctgcctcagcctctcaaagtgctcggcttgtaggcaggatacagagcaccccaccaagatggatctgtagttttggccaggtgcagtggctcacgcctgtaatcccagcactttgggaggcagagttgggcggatcacttgagcccaggagtttgagatcagcctggacaacatggccaaaccccacctctataaaaactacaaaaatcagccgagcatggtagtgcgtgcctgtaaacccagatgcatggaaggctgagactggagaatcgcttgaacccaggtggcggaggttgcagtgagctgagattgtgccactgcactccagcctggaggacagagtgaaactctatctcaaaaaaaaaaaaaaaatccatagttttaaggatggagatgaagttgaagtcatcagaaaagatcccattgaaatggaaaaaaattgtgaaatgtagtgatagcaacagaaaagaactaaaataattcagtgagagaactaaaataattcagtgagatctaaggggaaaatcctacaaaaacagagaagtcatcttgggataataaagcattcttgctagtaagaattataatgtgtttaattctttttaataatttcaactcttattttagattcagaggatacacgtgcaggtttgttatatgggtatattgcatgatgctgagatttaggatacaaatgatcccatcacccaggtagtgagcatagtacccaatagtttttcaacccttaccctcttccctccctgctcagtagtcaccagtgtctattgttgtcatcttcgtgtccacaactacacaatgtttagttctcacttataactgaaaacatgcagcatttggttttctgttcctgcatcagttcacgccggataatggcctccagctgcacctgtgctgctgcaaagaacatgatttcattcttttttatggctgtgtagtattccatggtgtgtatgtaccatgatgtgtttaattttaacattcaataaaggtagtaaaaatagactagatgctgataaaaacctcatcaatcatgtaggaaatgaactggaaattatcctaaaattgtaaaaataacagagcagtagttaggaggaaaacaaaggataatagaatatagagccaggagatcaaatattccagtaataagagtttcagaaacagataaacatatgaagaagagaaacaaagaataagagaatatttctgagttgagttttcagattaaacgctcttaattgccaggtctccaaaagacatactatataacctggaaaatttgctgccctccaaaataaaagagcaaaccttgaaagcttccaaatagagaggaaagcttaccaataacagaccagaatagggagaaattttctctctgcaactcatgaagctggaacagagtaaaacaacatttatagttttctaagaggaaaagatccaaggatcttacaggcagccaagatataattcagggatgagggagagaacttaaaacttacctcacagaaattgagtaattaagtagaaaaaaatacaaaaacatagactataaataacataaattgatataggaactgtgaacagagtaaaaactgagaatagtcatttttccttatgtccaggaatacgtttttaaaattatatacatttgatcacagagaaaatgtaactaggttccaagaatgcatattttgtggccacatcctaggactaaaataaaataaaactgaaaatttctaagctatttaaagatcaataagaataagaatattctatatcaaagcctataggatacggcttaatgaaaattcacagctttaaagtatttcactattaaataagaaagatttaaaacaaatggaatatccattctatttaataaacaagaaaaatgcaggagctggaaattaataaagataaaagcagaaattactgatttaggaaacaatagtaatagttaacatttatagtacatttaccatatgccaattactgaataagtgctttgcaagtattgtcttatttaatcttcataataactctgagataatattcaccatgaaaaataacagtcatgaacctctatgagccaaataactgcattaggttctatagagaaaaatagaattagaattattacagatatgtttcaaagaacttttcagcctttgatgagtttagcaaataaaggccaacactttctgtaaacctaagcaaattaaaaataaagctcagagaatttaaataataagacaaggtaaaatatgtctatgtttttctcatacaaacatggcatatgcttggaattaatatgtatagttcatatattaagactaatgaatattaaatttcaaaagtaggatcttgtacaagtcactgtctttgtctagaatttaatatacaaagaagctaataagtattttcaaatagaagttttgaaatttgaaatgtgtcctcatctgaaattacatattatcaggaaaaaaaacaaatgagaatattgcttatcaaaatttatggtatgaggttaaatctataagtataagcaaattaacagcctgaaatattttgaatattaaacaggaaagaatgaaataaatcagctaattatttaactcaaggagttctaatacatacagctaagggaaactagcaaggaagaactcaggaaaacaaaagtatgtgtaacttaactatcttaaagtgggtgcaaattgttaaagcgttttgctcttacattttatttctttttctctattctaattcactcggagtaaattcacatctatatcataactatttttttctaagtattgattctgtcctgaactgtttctaaaattgatttcagtgctgcaatttctttaatattctttcccgatacccttccatcttttcaaccaagtctgcctcccacttcagtgccctttcctaggacctacagtggacactactgtaccgtgggaccagcactcttttccatgaattgcctactccttcgtgggattgcgttatgggttgttggttgggttgtgccagatccaaggtggaagaaaaacagtcccctttaaccttgaaagtaagagaaagagtcagcagtcaggctctccctgggtatgtggacttgtaaaatgttaagcctgaatcttctggtagcccttttaatgccatatggaccagtctgtaatgagaatgtggagtggaacaggtgcacccagaggagcagatagcagagggaagggagagcctccattgttttcagccaggtcatcctggctgctcagagccatcacagaccttatgtcaacgagctatccaacattctttctgcctgtcaaccctgtttttggctacttggaacaaaaagaattgttactcaacacgttgtcttatatttccaataattatttttcgctgactgttgagaacacaacacagattctttaaatatttagttctgattcctttagtcaatctttcctataagtgtgtcctattcctctctgccttgagtactgtattttccactgttctactagagaaatgtttaataatctccagggaggttttttttctattttgctgtaatgcattcttgaagaaaaataaatctctccagttgtgggtggattctctttgattccttttacttcagtgctgtttgatgtatgcatcccgtaatcaattatctgaaggcttatagccctcttaccatgtgactcagctggcttgtgtaggaatctcctggtcatcttactgtgagtggtagagctcactctggttactctgaaacagcgtcacatcttctcttgccagaatcagcaaatcacaaaatccataatccccacatgagccgctctcagctctcccaggctcagctgttcctgcaactgagttcctatcttggaatgtcaagtgccactccctgtccagtctacctcctgcatcactggagattatagttctaaggataaagttcatgtcagggtgtgcttgtttgtaacacattgctacagcttataaaaagcacgggtcccttgtatcagagaccacagctattaaaacaagcagtggcaaatataaagatatttggacagtacaggagatacatagtgttaggaaagtatagaacttacataaagaaaataagttgcctctagagcattaacctctgggcccctgagtattccaaggttagtttttttagagaaataatttttaaagtggctgtagattgatcgaggagattggatagaaggttatagagagaaccaaggaaaaggtccttcaacctcctgttcgtgatgtgggctttctctactgctgtcatcctctcttatcaaactgtgttgccagaacgggcaagggccacagccatggaagaggggctaccaaatggaactccaacctaaggtaaagaaaccacatggtcagacagagagggacatctccttgacctctttcactgcccacttcaatttccttccaatgcctcttggggcacaaaatggggcagaaaacatcagagaatgaatttggagaggcaaacagagaaaaatcaaccggaagaaaagggagtttaagtcgagaaaatgaaaacaaaaataaaaacattaaggtattgagggaggtgacagaaaatgttaatacatttaaaatattcaatagacacttaaaaagtgcagtataatagattatagattaagaacaagaattaggggaccaaacttctaactaaacatgaaaaacattcatcaggtaagatcctgaacaaaataacttattttagaaagtgaaagcaaggaagtccaaacgttaaaaatacatgataaatttaaaatgcaacaataaaaataaaagcattgtaagtcaaggcaataatacgcagaaaaagtaacaaaattatgaatattagaattaattttatcatttttatgctttatgtgttttcagatttttaaaataaatatgccttattttcatgacctaaaagcaaaattttaaaggaacacacataaacacagcccagttagccagttaataatcagagacacacactaactaaaatgtaaattattctttcctcaagattttctaggctttcctgctattatatattattaatagaaaacaatgtattcaaacacttttaattcaactccttgctaggctgattttcaaaatattcttataaagttaatttttatatatgttttgaaaagctgttattttcaatactatttattatgtagattattatattttttcaaaagatctgtacaataaattcttcttaaagttcagtactaattaaaagtacatatttttatttgtctgccatgctataattggaaaaaaaatgaggtaacagcctagtctcattttttgccttggctccaaagaaattagatctaataaaaataataatcataaagctggaatgcttgttatatgcagttattaaacaaagcattttctataaattattttactttatattcatgacaattctgtaaagtagggtcttggcgttgtattaagtaatttgcctaaaaccacatcaatagttaatgagaaaatcaaatttttcttctgtgctgtgcttactctttcttggctacattgaaaactcaaccacaatagtttctctttctcaagctttctgccatatttttaaaaatatattattctcctctcgagtagagaagaatcaagtagcctctttgttgttgttgttgttcttgttgtctttcctatcttgtatcatatccatttcaaatcatatggtgaaggaaacagtacgtttgatattcagacctctaatggggatattccaacattccaaaacatataagaacgttattgtattacgttccgaaggcaaccaattgtgtgacacaagcataaaaaagaaaaggagggatatgatagagatcgagcatgacctcgcttcagcacgggtgaggaaattgaggcagcagtacctgcaacagtgtttcccagcctcacacttgccctgcctcccactgcccagggattcttatgtttctctcacaaccccctcatctctactctcccactctgccatgggagacatgtctatattgagaaccactgcattttgtatatttacacccaaaacaattttttcaagttttactttctatagtttacattatgggaaaaaagatttttcttccttctgatataatcagcattgattcaatatttttagaaaaagcgccagccccaaagggtactcctaaggtacagaaaagttctctcagatgcctgtattttctcttcccagcccttccctggatcatcacagccaccatcactaagctgacaatcatggtcctagaaaatatcataaagaccatgtagaccacaaagtggtttgtctctttaagacagggggaagagattgcttcttgactcttacattttctcctttgtttaataaggttatgtaacctccaaatgtatgtcttaatcgcatgttccaaattttctttttttaagggaaagaaactcaattcttttttttaacttttaattcaggggtacatgtgaaggtttgttacataggtaaacttgtgtcacgggggtttgttatagagactatttcatcatccaggttttaagcctagtactcagttgttattttttctaatcctctctcttgtcccacctgccaccctccagtaggccccagtgtgtgttgttaccttgtatacgtcaatgtgttctcatcctttagctcccgctcataagtgaaaacatgtggtatttggggttttgttaatgcattagttttctaagcataatggcctccagctccttccatatccctgcaaaagacatgatctcattctttttttaatgactgcataatattccatgtgtatatgtcccacatttcctttatccagtctctcaccattgggaatttagattgattccatgtctttggtattgtgaatagtgttgcagtgaacatacacatgtatgtgtctttataatagaatgatttctatttctttgggtatacactctgcaacaggactgctgggtcgaattgtatttttttctttaggtctctgagaaaaagccacactgtcttctagaatagttgaactaatttacactcccaccaatagtgtataagcattcctttttccttacaacctcaccagcatctgttattttttgaccttttcataatagccattctgaccagtgtgaggcagtatctcattgtcgttttgatttgcatttctctaataatcagtgatgttaagttctttttcatatcattgttggacaacatgctctgaattttcaaggattaaattaccacgtggaaactccacctggtcatcttacctttggttaggtcatcccaggttcaagaaaatccactctctggttaagatggacattgcaaagagagaaggaaaactctgcctgtaccagacttcctggtcattgccatcttcaccacagcacccaggagaattcaaagtcagtaactttttgagtatggaggcaaaggctactttcactgccctttgcttctgctcatgacattttacattaggataaaatccagaatcaaacagaatataatagggagctgaaaactgaatatggataaataaagtaagccctgaaaaaataggagttgttaatggtccataattggtctttgtaactttatagaacagatgtaattccaaaaaagatcttaagaaatcatagccagagggtggcatataatatataactgtcatattctgatctgaaggagagttctggggagaaataactaaattagcagcatgtaaaacaaatgtgtttattgttatctattatttatggccctctggatagctgatagttcatttgactatacttctgcctaaaccaatttaaattaatttagctggtaaattgaataatgctatatcaactgcttttctgcaatcaagatatattgcatatactcaactctcttaatcaactaagcatattttccaatgttgatggataattgcctttaagtgcatcttgcccttctgcttttaggtctggttgataggaccattactggaagtgataggttcccagaaccattttgagaatgcaatttggcttaactctcccatcagtggttatcagtataatctgagggctgtgaaggctattagctttctctaatggtctttgcatcccttaaataatgacaaaaagggctcatcagacaagacgaaaacaaacctcaactttcaactccctaatattttgttcacttcactataaatgttcactatagttcataaagcacataatcccaaagggaaagaactcatctgtaaagatttgtgtgccaaatcaatgaatgcagagactgcagcataatatgatctgtaatttccaaaaataagtttgtaactggagtaactgtgtctgtttccacttataatttgcttgaacatttgtattacggcatatcaggaagctataaagaaacagtgttggtaaaagtctggccttatagacctgtgtcaacaactaagctgaaaaacgtttttataatgcatgaaattccaggtctccttcaccaatgtgacagattcagaattaggaattgtttgcacttcctgtttctttttaagcagtttactatatatcgtgcctgactttaaaatcttagtttgtatatacccctatccaggtcaggaaatcttttctttaattttttattactgattgcttatgcctttaatgtttgatgttagagcttgaatgtttcaaattatggtgtaattttgtgaacttagcttagaggtctgctgcaccttttctcagaaggtttctgaaaactaagctgatcatgattattgatgactatagtgatagatatgcagatgattatcccccatgggaggacgtcctctagaagggttttccagatgtgattgcgggtaaccggggatccacctttttttgctgggtcccattgtgattagcaaacccaaatgttgatgtggcatttagtacaggcagtgtcattctagataagagaggaaggctgccttttttagaccacagagaaaaccaaatatttctttaaaaattataattcttttctgttgaaaaataaaggagactcactaaacctcagggactgattaagccttatgatacctcaaacctctaatgccaagtgaaaaacaattttaaaatactatgcttctgtttgttatatcttaccagatgagactgttgatatatgaatatattgctttatcttgagttgatatacatttctagtatatttataagagaaatacattcataatagaaatatatttctgtgcattggggccaaaatcaaaatgagatcatatatgggaaagcagtttatgctttgcaataaatttaaaaatataggatttattacatatagatttaggtaagcctaagaagcaagatgttccttcagcactatcacattgaattatccaattgaaagtgtgttatctgattcttcaccgatgtttcaaagcaatcgtttgctcatcgtataatttcccagcccaaatccttccatacatgaaaaactgtaaatcagaaaaaatatttaccaaaggaaccaaaatgactgcctcaaatcttctctggttttcaggtacatgtgttaagcaatatttcaaaagacataaatatgtataactgctttatgaaaattcatgtgggttattttcagatattagataattctatatcattacatatagaccgaaagaccgacagacacacacacacacacatatacgcatatatatacatacataaaagataaaatcaggcacaggaacagtggccagctttttgtattttgtttaagaaacaaagatgttttgcattaacttttcaaaaagtgttttgactcaaaaccatactttaaaaaacataaaatataaataaattcaactttatggtctttcagagggagagtatgctattattccttgcatcattttaccacagatttttcgacactgctacattcaaagtgaatatttaataaatgtttccattgaatggttggctgaaaaatattttaaatacatttcaaaaagagagttctatgcatgccttggaggtgttcagttactgctaatgataataaagaatacatatttacagcatacataacactggtccagaaggagtttaacaaaaggttaagtcaagctgtaaaaccccccagtaaacatccaactatctataacctgatcagattggaacaatggagaatcaccttctcttttcccagaaagacttagcttataaagtgatgtttgcttatctaggtcacccttgtttatttcaaaccagtgttcagagtcatttactcttctctgctacttccaggctgtgcacagtgtgtgataatgacaaatcagttacagcagggtttgaagtaacaaggcacttttgtcaagtagagcttatgagtttggaatgttccaaatactgagccatgatattaatccagtaaatgctcgagttagactcaagtcagcagatttttataaagtgactcctatgtacttagcattttgataaggattcctgaggagtttttatctctggggatttactctcattagggaggacagatttatgtattttttaaaacacaacaactagaaaacaaaacaattatatgacccagtaataaaatgtatgctgcagattataaatgtttgaggaataaggaaattagtgtgagtagacatgttcatatttgggtttatgaagagagtaggtcttagaaaatgagcaggacatggttggtaggaaggacggcagagacttgagagggatatggctcacacacatgcataaatattggagcacacatatctgagtcactcctgcagagtaataaaaatgaggactctggcgtcagctttcctgggttcaaaccctgcccccgcatcacagaaactggctttatctaaattttctcaagtgcataatgggagaaatagtagtacctagtgctgctgtgaggttttaataaattaatgtgtgtaaagcatatatgctaatatatgtaaagttgttacatgtaaaacactcaaaattgtgtctgggacaagtaagtgctatataagtacttactcaactgttaactagaaaaggtatttgggagtcaatatggatgtggcctaactgggtcaagaatatgtgcatgtaatgggaatataaggcagattagtatcttgtattccatatttgcactttaaataaatggcaaagcctgtgtagaacactaggttcctgcctcccaggacattactctttctatgatatcatactgttttcctatgtttccaattttctcatctttaaattgaggatactataaacctcataaattttttgttaggattaaatgagttaagacatgtcagttgcttaaaacagtgcctaacatattgttaacatgcagtaaatgttaagaaaaagaagatagcaattatgagttgtatttcttagcttttgctgcgtaataaaccaccccctattcatgattctacaaactggaagtatgtgcttggctcagttctcatctgggccagcaaagctgaattcatttgagctcactcatggtctacagtcaagtggtgggttgggtgagtagggattgatgctttatgaaatggtctccaatggagagagctgtgatgactggaaccaactagcccagacttattcacaaagtagagcgttccaagaagtctcaaatctctgtctcctgtttacaattgctccactggacaaacaagtcacaccgtcatgccgagagtcagtgtagaggtgaatgacacaaagacttgaatataagaaggagagaacaaatttgagatctttactgcagcactctataattacatataatagtatattaaattcaagaagcaaaccttccagttaaaggtggtgatttaactaaatgtgtaaacctgcttcttcctcctgaaatcccactaaaatgtcaataaaaaataaataagtaaccctacagggataaagagatggggaaaagaaaatatctgaagaaatatttcaacaatgtttttgttaattgatttgacaaatcagaggaagttattcatcaaaatactttatcaatgagaagtaatgtaaattaagccactcgacctccctgagaagccctagatttggaggtttcaagtactgagaaggttgaggggtaaaaggaagtcctgagaactgggagattggtttgatgcacatgcagagagcaatcagacctcagcttacctcctccacccatgcagataagaactacctgctctgaggcaggaaataggagatcttttgtctggaaaaatgaagtggaagattttaggatttggaaacaacaggtagtatgggttggaggtaaagcctgggattagatgaaagtctacttattgaaaaggaaggagatagttgggttatttaaagatgctgcttggctccagaaggaaaatgtattgacatttaaggatgcaggggtttttagttgttcttcagccaaacagaattccccatcagttcttcattgatgaattttaagaacccagaataatgcctgagtggtaggcattcagtatgtttcgaatattgcttaaatgagttttaatacttcatttttagacataggtcaggattagcagatatttgaggaaagtctctaacatgaaagagaaagactgaaagaaataaacatcaaacatgaaaaaaatccaaaggaaatggagctctaatgggagggggagaagaaagcattgtaaatgtataccaaaaccctcagagagtttaagaaaaaagatagatggctcataaattagacctgaatgctattattttaaaagaacaaaaattaaaaattttgctattaaaaagtcaaagttaaaattcaatggaagtttaaacaataatcttaagaaaatctcctcaaaagaagaacaaaatataaagagaagaaaatagaagataaaagatgagagatttagagtgtcaaaactagtagtccaacatataacaaacaagagagttccagaaagagaaaatggaggttcaaatacaatcataagaacatctcccaaaactggaaaaaacccagtctccacgttgaaagacctacctagtgttttgttcaaggagtaaagactcacagtaagacacattattgtgaaatttagcaatattgaggaaaaagagaaaaataacagctttcacagaaaaaaatcaggtatttataaagaaatgaaaagcaaattaacattagacctttttatttttaaccagaaatactatctgctgttagtcagttgagaaattcctttaataattctgaagaaaatctattttcaaagtaataacaatcaaattgtcaatcagtttggaagatcaaaaatctcacctcctatgcattttttctaagattcttctccaactaaatgaaagagtaatgaagaaaaaggaagacttgatgttcaaacagaagagaattcagtttgggagggcagctgttcagcagcctagaaagctgcaagtgactccagaagaaccctttccaggaaaagtagggaagtggtagattcactgatgtgatagggctttggggaaaataaaacttgtagctatgtggagaattaatggagcatttgggagcaaaaactaaggaaaagaacataagaaacaatacaaatggaaaattgggttttattgattcaagaaaaaacaaaaagttatacttaaaaaaggaaatataatacactgccactccgaggaacaatatttaatgatcacactagtggaaatgctgattactgattcaacaacaacaaaaatgtgatctcttaaattaggagaaaggatgggacaagaaagtgggaagtggaaaacagttaaatcttcatctaccatagcagaatgtcaaatgatgatattgaaaatatgtttttttaaaaaacagaaacatattatttagaaatggaaagataagtgccagaaaaatcagcttaaagcaatgtttaagtagttacctttggaggataggactacaggtaaggaggaaagtagaggagatatcagtttttcaatgtaaaatttattttttaaactatgtgcttgcatgactttgataaatatgaaataaaataggaggagacttgaacatagatttgtcttattgttaatcatatttcaaaaaatagggctgggaccaggatctacccatccccatcaagcgaggattgatactaactacagccactcctgcgggggcccagggttggtttgcagttgttattgttgttttgtgaatgcctgtctgtgtgtatgcaactacccttagtcactagccaaggctttacccacactggctgctgatcactcgccttggcattgattggcctagagcatgcatggaccctagaacctctctttcccactagcccaggcttttcatcggcttcatttttgtctccctcttggccttcttagtaggcacctagcacagcactctcctggctctgtttttcagtcacagcatgagcagaaaaaagagaagaaggtaatgaaagtgagagaaaatactctcatttagcattatttctaatctctacttctatttttctatttaaagcaagtcatggctgcccaactgatatttctaaaagtccactttgtgtttgactccaatcaggcctcattatcctaggggaagaggagatggaggtgagaggaagaggatggatgaatgtggaaggccttctgcagcttagcatgcaatggtcatttcctgtatgcaaggtcttctgctatgttctgtgcaggaaatcaagaatgagaaacaattttggccctagaggccttacaaatatatcttcctaattacaaggttatagtcctttgggaattgcaagttcccttgaaaattcacacaatcctaacatgtgttgtgcctagtttgatgtgttcttaaactattactagctaacacttcttactgcagaatttctgtggaaatgagacataggtatttctacaggataaatgagacgagtgaaaagaggtgttgaaaaggaaaacgaaaggatgaaacagatacaattcctacttcgctgtttttcaaagtgcttatagtgagtgctctccgtttctcacccgaaggggagaaacttccttggcctttttcttcaagtaaatagattaaatctctcttattgctattgctatttgacctttttcatgaagcatagcaaagagtttttcataatcctaatatatacttatggtttgtgactaatgaaaagaattatttccatcctctaaattaataggcttgcctccctgcccagtaagttgttccttcctatacagcattcagtaaaatatttgctgagtaactaaaatgtccaagacacctatttcagcaatatatgaactagaaacaaaacaataactacaaacatgacttatctcttcaaggaaaggagtcaatattcttgtacggaaaaaggatcgtagaaaaatacctaatagcatagtgtgacagaaattgcgtggaaattactacaaggcagcaagtgagatagaccctaagctgagcagacaataagggtatggcaatcctaaatctacatggtgtggtgattaagtcctgcgtccatggagtcagaaagagctgggtcctgactctacttattaactgtgcaaccttgaataagtcacttataccatgagctccaagtatctcatccttaaaatagatacatttcagcaccttattgaatttcttcaggctaggctctagggatacaacggtgatcatgacagttatggtctcaggccttattcaataaacagcaaagaatccaaattgggataagtattctgaaagggagatatgggaatgaaaacgaaaagtaaaccaaaaagtaaaacctttctgagaccagtgattttgacagacactggattatagaggacctgataaacgacaataaggattttaaactttaacctaagcaggagaagaattgattgaaggggtttaaatacacttcctttacagaagtcttgcgactgttacatgagaaattggtatgtaacatttttagtgccttcctgataaagcctttgcacttctaactactgcgtgagttactctacagggaatatagctaaacccgggttatttggacaccacaaattcctttcttaacatttttgtttaacatctttgttcaatattaatttagggagaaagtaaagaaactaattttatattactaaaatcatatacttctttaaattgcaaagaagggctgtatcccttacattgatcataacattctaatttacttggaatagtctgttcattattttctttattcataattggatattgtcagagctaaaactatacctagaggtaaatcatgtaactatgacacaaaacattgttttttgtttgttttggagacagtctcactctgttacccaggcttgagtgcagtggcgcaatcgtggctcactggaaacttcgccttctgagttcaagcgccttctgcctcagcctcctgagtagctgagattgcaaggatgcaccatgatgcccggataactttttgtatttttagtagagacgaggtttcatcatgttggccaggctgctctcgaactcttgacctcaagtgatccacctgccttggccttccaaagtactgggattataggcatgagccaccatgccccgctgcaaagcattgttttaaataagatgtttttctcactttgtattagcaaaacgttttctacctttttatgatttttttcactttcatttgtgatctcctacactaactttcttgagtggtatatagttgggagatattaaatatagatttttaaaattaccttttttttcaggtaaaaaagcgctattctatgtgttacgtattttcctaatttcaacgtcctgtgactgcccacttcaggcagttgtcagatctcagggttgatgagagccctgcagttgcgttggggaaattgtgtatcagaaaatgctccttgctagagattggggccagtgaaaatagcccatctttctttcttccttccttctctcctttgttcctctgtcatttcttttttttttttcttttcttttttgaatcaagggcccattcttcaggagaagtggtactaattcacatctcactcatagaaggagttacatgtgaaaacctgaggtatctagtagtatatttctgattccctctatggatgcttaaaatgccttatagctgtgtttcccagacaggtgcctgaacgacccacccctggatttaactctgatgggaatacatgtgaaacattactttaaaacatatatgcaatttttaagaaacatgtaagacacctcctcactcctactcacccttgaaatagtacccattcttctctgataaaagggacaccttagtagaaaagttttacaagttctgatgataccagtacttaataaatggccatattattattattattataaggaaagacaaagaggagattgagaggctttgaagcttcagaaggagattgaactacactttgtaggcgggtaggacagatgaatggagaagagagacagagttctagacagaggacatggtgagaaaatgtatggcatcagtctgctcatagtgagttgaagggatctggataggacaggtggggtagagcaggtagaaaatagctttgtgattcagagagaaaaaattatgctacagtgtgacaatgtaaactctagggttaaaaaagagagagaacatctttgattcaacaactttcttcactttccgaggcacaaaataagtttcaacgattatgagtatgaaaaagtagcctcagagatataatcaaatccaataaataatatataaatgaatataataaatacattttccctcacagactctgataaagaaagcagttaataaatacagatgtgtgctgctactgcgtactgagaaagcttccatccaaccagagaaaacaaatctgaagttaggtccccttcagtgaaaatgcatgactgtgaacttcttcataatccaggaagggagaaagtacatacattagtcaaggcagtgcactgtactgcattgtgtagtctattaaataataacatatatgaaatgaatggatcggctattcaatgatatgttcacttacggagtatcaggtcaacctgaaagaaactaatataaccccaaagttaaaaggaagatactattgtagtaaaaacttgaagcctcttaacatatctgttaaaagaaaacaataagcattaagtttaataagcttaatagacttaaccgaaactagcacaaaggcagttcagtgttaagagtaggaactgccaaatcactgccatttgcccacttttcttctggcttcaaatatgaaatcaattatgttaattttttgaatacgttggaacattccaaaattttattataattatatagaatattagataaaacatttcctgtatttcctccaaaatgctagaaaaggagttgtatggtagataattcttaactgactttgctcttatccattcctacttagagatttttcccgtatttgtgataaatgtgcaggatttttgtatgtgaagtttcagtagaaaacatttgtcttatatgttcttagtttatacatctttgggaaagccagtcaaaagaaacatgagagctatttttaggtgctttccctacatttttattgccttttaatgaaagagatctttgggtttttggggaggagatgataaatagtagggagtgtgaagtttaaaagaacatatatcttggctataaattccataatgtgaatacaacctcttttgtttagatctcttaattttttctcccagcaatgtacagtctgtttgggaatcattcacatacttaagctgtatttacatataagaatcatgctttggtgaagtaggtgataaaggcatgggaatcttccagaatgtaaagagaaaaaaaaatcaaataattaggagtaaaaaaaaacactccaaacttaaaaaacattcactcatatttagattgagagaaaactcaaaatgctgagcacattcatcctgatgaaatttcgtaattaaaaaaaggaaaaaattagacaagcctccaaaaagagagaatggaaagggaaaagagagagggagagatggagaatgagaaaaagaattgcctactaagaaataagaatcaagaatcagactgcattagacttttaccaaccagattttagaagagaatagaggaatttattcataaatgtattcagagttccagaaagacattctgaatctagaattttaaaattatgtatactttgtatatacatatacacatgtatgttatttttgaagaggtgtgctcacatggctcaaaaatcagaacaacataaatacatacagagagaagacctctacatctgtccccatccactcccttgtatataagcagatttactagtttttttgtgtattcttttaatactttataaatatataagcaaatgtatatatataatcttctcctttcttatacaaaagatagcttactataaatattgtactattgctttctttaattacttaataaaaaatgttagagacctgactattttagtaccaaaagatccttttttttttttattgctgcctaagcctgtgtagtgtggatacaccagaatctctgggaccagtgcctattgttggatacttaagcagtttccaacttcttagtgctgtaaacaatcgtgcaattaataatatttaatatacgttacttcttaaatacccatgtgcatctgtaggatgatgttccagtggtggaattactaagaaaagttaaatgcatttaggtaaatagtatcaaatttccttcctttggagttgttccattttggaatcctaaaaacaatgcatgaggatactagtttccccacagttttgccagaagaatatgtcaacctctgggtttttgctaataaaatatgtaaaatatcatacctctgtttaagtaacatttgcatttctcacattactgttaaggtgttgcttcttttgctatgtttgtgggttgtttatgtagttatctgtggatgatcttaactgttttgggggaggttgttagtttatctcaattactaaaagttatttatatatttgggaattagcctttgttggtgacatgaattacaatcaaccctctaccaccaccaccgattttgtgtttatcttttgagtttgcttgtagtattttttccatgcagaatttcttgatttttatgtagttaaaattatccttttcatctttagtgacttctagattttgtattttattaagaaaggtcttcctcattccaaggacataaaagaattcaatgatattttcttgtacttacatggtcttattttttaaattcaacctttaatcaatttgggatttattctggtgtaagatgtgcaatgctaacttactccagatgctagctaattgttctaacaccagtaataaatttatttttttttaatgaacatgagacagaaaccctggactagtttttttataacttcagattgggaaagacttttctaactgtcatacaaaatccggtagtcatgaaaaaattaacactgatcattttaaccatataaaaattaaaagcttcatttttctcacttacttgtgatgacatccttattgtatgctagattcctgtatatatttttctttatggactttctattatgttttatattttcatgcagaagtaccacagttttaccttttgaggtttatgaatattgggaatccctactagcaactgcctatttgcctatttgtttcatgaagaaacagcatgcgctcctggtgttccattctgtttattattgacaaagaaatcctgtatctcatggcttgtgctgacatttgtatctggtctcttgcacctagatcctagagttaaactcaaatgagagtcttgagtgcaattctgctggcctaacaagacagaaaatagcacaaacaaacattgggaagtggctcttttgactcaacctagagcttccgacccttagccatctatctgatctataaaaagagagcaccaggccgggtgtgttggctcatacctgtaatcccaacactttgggaggccgagatgggtggatcacctgaggtcaggagttcgagaccagcccagccaacacgatgaaaccctgtctaaaaattcaaaaaattagcctggggggtggtggtgggcacgtataatctcagctactcgagaggctgaggcacgagaaccacttgaacccgggaggtggaggtttcagtgagcagagattgcaccattgcactccagcctgggcgagagatcaagactccatctcaaaaaaagggagagagagagagagagagagaaccatgtgtcaaagacagcactttttccttttttgtatattttccctgggaatgaaacttgcccttcaactctgggctaggagccctaaagccggatcatacatactctatcctataattaaatgccactactgtttctccacataaccatccctaaagttggcattgaccacagggtgcttgaggaagagtgtcaatgttgtaagcttcccagaagggaagtcaggtgagagagagggctttgagacaatcactctggtcttcgctagagtaggagaagagaattgcataggtgagagcctggctgaagttggcagcaccagaaaaggattgcactggggggtaatggcgttcaaactgcagtggaccatggatatttatggactaggtgtggatcctgtagcaataaactaatgtgacatgcattaagagttatgctacccaataaaatcactttggaagaccaatatgatctaataagtggatgagtcacaggaaaccaagaggcagaatggagtctcttaaatagctggccagagaagagatgttaagcataaggagagccacagtcagattcccagagggaataccagttctggatattctctaccagcacagggcacccatgcctgttcacacctgcacaaagcagctagcgagtggatgaaaaagaagagaaatcaatcacgtcttctttcactgaagtcttcccagctgagtcaaacctaggtgcaggaaaggagaaatttaaattgggtaagaatttgggattttgatatttcccttaactgggccagtgtttttattttcagaaagtatctagaagttaaggaatcaagcctgagtgtcatctcaggtatggggaaaataagttgtggaactgatttgaatgagcagtggaagaaaaaaaataaaattggtttctggttgtttctcacaaaaccaatatgttcaatgaatcagtaacaaatacacagtcctttttcaggacgtttgtacatctatatcccggcaacattggatcaagccccctcagtatttaatgaagattctattagcatttcgttccaaataattcatcatttgtgtgattggcccatgtattacaggacttttagtatcctacattcttatcctttaaatgtcagtcaagctcctagtaattctaaggaatgtttcctaagggcggtacctccacaaattgagaaacactaactcacggtaaatgagttgatgctgacaacctgagtatcttcaaatgacatgataatccccagtaacatattgcaaaaggtgaacttggaatggaagactctagatgcgctctccaattgatgtcctatacatttagtaactttaaaagtaggaataaaagaataatcaattgaacctaatcaatttccttgggatatatatagtagcccttaaaatggctaaacctaaaattcaactaagaacctagaataaatgttctgttggaaaaataatggctctctctcaagtcctacccaaacataatatactatatgactttatgatcccaaagtgtcatctgcaataatatggtgagaatgaactccaagacagttacaaactgaagtatttagcaagtaatgatttatcagagaacatatttgctgaaaatattactacttttaaatctataaaaaagagatggtgtctaaaacatagctctctatgacattaataatatataatcagatcttttgcaagtggcacctggaaagatagcatggccaaaaagtaggattaaaatataagaattaaataagaaagtaaaaataaaatatgctgcattgtgttaggaacatagatgtttaaacaaaccacaaataaaaacaaagatacagttacaaaaaaaataaggggcagaggaggaggaagatggtgaaaaaggaagagaaagggaaagattaagttaaattaaaggtgggaaggaggagatggagtgccagtaattatacattaaagaattagatttatctctctccaagggacttaagtgatgacctgccattagttatcatggaatgtgaatccgaaaataaagtggtaagatcagcagtggctttattaaaaatttaagtggatgcacctgaaaaaaataaaactgtaggcaaagtatcctttgcaagaggctcttgaaccaaatcactcaaagataaatcaccaaaggtagacattacaaaggacacattggcttccaatgttccatcaaaatggctggtgtgtgacagtcactggaatctatgaatggatgcaatggaaactgtgaggtaaatggtccaaggggcatagtcctgcaaactggagctttgtctataataaacactgtatggttgaaagtatgaagattcatcttacaatgcagagagatagacacaatatttaaactactattacacaaataatttagataaaagaaaatttaataaaatatgccttagaagtttccatgctttattacctgtagaagaacataatgaaacatccctcactatatttagcttactgctctcccaactctggaaaaatagcctcactctggaaaaataactatcaaaccatggttttatactaaaattttaaattatgaaatgagcgtcaattttcattccaaaacagagtatgagatttagcagatttgttgactcaaaaataaagaaaagatgtaaatcttggctgatcgttaatgtttttttcttgttccccatttacttcttaagtgtggacccttggattcttatttggcctgtgaagatgattacaacaaagggctacatctcaccaagatatctttcatcaagctaatcatttttaagaattgctaaagctaattaagcccttgtcaaacactcagcagaattctaatcaccttacatgtattcatttacttaattctcatgacaattttactattcaccacttatgacaaatgagagcaagaaagctgagctaccaagagattaaataacttgcccaaggacatgcagctaaaagaaataaatatttttaagtctatagtccctctccactcccaggcaaaacgactaactggtgatgcgcacacatgactcagaaaatgagacagtcgtgatctctctattaaataaaattaaactgaaatgttcggcttgagaaagtcctcaggggacaaagaccctcagaggggaaataggcttgcctagagatgagagatgtcatgtacagaataagtggaaggctccttgttgtgtggagtttgtcgtagtgtcacttctaatcagttgggtaaggtccaacacatcctgcttttggccaggtgctgcaacagagggaggagtattgaaagtggaaaataggtttttagaagatagatgatccattttgggacataatatttatggattaaaacaaattaggttcagctgagaaaatgtaaaaaatattctaacgtgaattagaaataaaatttttaaacacacaaagcccatcctaaaatatatacattcatactgcacttttatgcagtagtggcacacacagtttctttgatcatctctatattttttagtgatgatgactttggaattgactaaaggatgtagcaaccattttctttctcattttacaaatttgtaacttgttccctggcttattgcgatagtcttgagtgtttgggttccctcaaaattcatatattgaaatcccaacccccaacgtgatggtattagaaagtagagcctttgggaggtaattagatcacctgaaatgatattagtgcccttataaaagggaccctagagagagccctcaccctttccactatgtgagaacacagcaagaagacactctctatgaaccataaagtgggccctcagcagacactgaatctgcaaccctcttcattttggacttcccagcctccagaactaaatatctttgttatttatttgaaaaatgaatttttgttgtttgtaaaccagccagtttatggcattttgttatagcagccacaacagactaagacatttataaaattgtagtgataacacaataataattctatcttcaactttattaaattaaaaactttgaactctttttctattgacacctcaatttttaaatttgccaagtatagtatttgtttatattgcatactttaaatatagatatgaatttgcttgttaatattttaaagatacactaaaaacagaatgtataagacctgaaattgtttattcccagaagaaataaacagataaaacaataggccaatcaatcaacattttgtggatcatttgttacatgtaatatttttataaatatttatggaatatattctacatgctaaatataaggtgttatataagattttagaaggcatagtggctcgtgctctctgggaaaggtctacgataaacacgctgtcattatggaaggaggcatgtaacatatacctcaggaatgttatacatcaggtcagagaatgagggaagaggtcatctgtgttggtggcagcaataaatgaaggtagtctggtgcaaaggaagtagaactaaggaatcaggagacggagaataaacctttcagatctgctgagctatacgattattattgggagtacaaagaaacgtgtaagctgggtgaaggtggcaaagagccttgaaggccagtctagagctgtttgttattacatagataaaacatttggatggctgatctcttcacccaggtatttggcgttatcccaggatttgacttggaattttaaattttttaaaaaaatcaaaaaaacataattcttgtgtaaaggtcaaggaatatcttaatttgattttggaattttgttccaaggggagtagtcttaccactatcccttgagacagacaaaaagagaccaaagttaagaaaataaattctaacaaaatgtcaaaaagatcggaagaccaatagcataaaatgtgcctactcttgtataattttataaacattaacactttaaatggtatctaaagtggtatagtctcctcacccacacacagtcaagacacaattatcgcattggctattcctagatcactattttaagtactaactgcacattgattttccctgaacttacttcgaggttcaagaatctttatttattcgtgcatgcacttaaatctgtaagctggaaagtcgtgagttcaatcgtaaatttgggagtcatgaagttgtaggcagtctagagttcaatcataaattttggagtcatgaatttggcattggttttagtcctaccaaaatgtatcttcctaactctaatccagtgacatcactatggccttcagaccttaatcccccagcaggcacaactccaactataaacagagattttcacatttaaactataaactccatataaccaagggttttgtagtgagtttagaatttatataaaactcagattttaatccctataagcataaaataaaaataaaaactcttcaggcacaggctttaacaaaaacaaacaaaacaaaatgtatttttctctttcttgagtgaggaatgaattaaggaccatctgtcaccataactttgaaccacttgatcttggtatgcttttttggtcagttttaatgtttcttaaacccaatttctcttgtcttctttaaaatggactaatctccaatcatcatggaaataagtcaagtaaatgaaaaatcataaattacatggggactcactaattcagttagtttatttggaaacaaaatgcctggggcttcaaagagaagaaactgccttcgcttcaattccttgtatgcattggccaaattaacttgccaaggaaatgacagatgatttaacaaagtgagtgaccaatgcgactttctgttccatccagagacgtgttgggggtaggggtgaggtagggcttggggaaggatagaaaaagtctggagcatgaattccaaaccatggcttttatgaaatactcagattagtcacatttcccaactaagaaggtattgtaaaacatccaaaacattttcaaacttaaaggctttcaattcaattattttaaattatgtataatacaaagcactttaagaaaggtacaaagcccaaaaggccatgaaatacaaaattcgatatctgccaatcagaaactaactgaaactctcttatgtgattaagttacattggtcatcaatacaagaattcaggaattctacaaagtgtacattgaaaattaaaaatatatcaagaacaaaacaacaacaaaattaactcaagggtaagtgacatttatcttatagccatattgtggtttccaggtataaattgctttcatcgtatctatattatgacacaatcttgtgagatgtgagaggtaagtattactattatgagaaaaagaaaactgaaaaccagaaagagtaagtgatatattcaaggccatacaggtaataaatagcagtgacagaagaaatcagatatccttaattattccaattttccaatataatttgctaattataagatagaggtgagtaaagtatagatgagaaaaaatattttgcagaatacgatgtaatattcactcatttattcattcatttgaaacataatttcatatatttatttgtctcattttgttatgaactggtaactatgttaagttgaaaaataaaatatagttttaaaaaacaggtagtcaattatagaatttttatagtggtaactagtgagataaaattgatattatctcatgacttttgcctctctgtcttttagagagttgttgaattcctccttgcttttccctatttaaaattttctgaagatttttgggatgagaactacaaaacagaattacatcttgaatttcaaagctcccttatataggatttttctgccaattctaacctcaatatcaaatggcttatttgaaataaaataatatgctattgggccaaaatagttttgagaaaagtaataactgcattacgattaattatctttgctgtggaatcaagtaggaattttaactctgcttttttaacccttgcaattttggatagagagagtatggattggtaagtgtagacctagcctaaggggtaactcggaaaaagattcctgaattcttgtattgatgtacaggaagtagaaagcaaatgtcaaatacaaatgtaaaacaggacagagtaaactattacagcagaccacgcaagtggctcagttcaaacgggcttgtctgggaattttgtgctatccagatgggtcaatttgatacatgcacttatatacatcctatgagagtcaactaaagtctcttataactggaatgtttcatgagctgacagcttatgaaataccaaagtatggaaacacaagcacagtgtgaggaaaattataataacatacaaaaatcaactttaattacttgtgcattaattggatccaaattagttgtatactcacaagtagaagcatttggatggatgatatggacatctgctagatgtgtaggcaaaggcaggaagataattttattttcagctgctttaggaaggaaacaaagaaaatatagccagtatgacaggctaattacataaattatataatttcaattgctgtacagtgaattatcatgttaatcaaagaatcaccaggttagtttgggcaaagtcatttgaaaagaaaacaacagttttaaaaaatgaaataaaataattgtgaaagcagtgtgttttctaagtaaatacatatattagaaccttgggaatgaggtttaaaaaataaagtgaaagaaagataaaataataaaagattaagatatgtaaaaggttctatttaaacatttagaaaataaaaccttatctgttggtaacatgttacttcacacaaaaccagaaacattgctgagaggaataaccgcttctagccatgttgtaaaaaattaggtaaattaccagaaaacctgctgcttctctgtctccaagctcccttctttcctatcatgttcagaaaaaaatatgttgaattattatataacacgccacagaattttgttctattgatactacttttgtgttctatttctggtcattgtacattgaatttacaccccgacccgcaaagttggataaaatccatttttttaagtcccttcatgtttaagaatcctacataaactaccttcaacagactattccagtgcctgtgtcgagatttaaagccatgtaacacctggactttgtaagcttaacctgctgtgacaaataaaaataaataagaaagtttcccgtagttgacaacccaggtggaagttttactacaatttccatcagtcactgggacaggcttcaagcgaaataaactgtatttacacacaagtttgctcagaaaggtggctgtattacagctttatacagcctctgaaactcgcaaagagatctatagatataaaaaactgtgaaaataaatccccttgtccacttgaaattttgctatatctgtttacatgcatcttttctgtatctacacaacttggaccaagtgaattttgttctaatgcgagttgggggtggagggtgggtctgggaactctatgttgaatgtcataaatgctatgggtgggggcaagggaaggaagatgttatgcatattctctcaggtctctatctcacattgattctgattttagtcttccttttactctgacttactgacccgatggggcaaaggaagtgtgagaatttgaaaatactgtataaggatacaaattttaaaaacttcaggcaagtacagtctaagatagaatgacggataaagaaaccaaagtctaggatttgaatcaaaatctcaaaagtatgtttttaactaaatttttcttgtgtataatgtcaaagttcaagataagtaggaaaaaaaagagttgtaggaggagactttcaataagatctgaaaatgtgttctaaagccaccacagttaataaagaatggtgatattgacacaaaaataaaaccacctggagttccaagaaacagaaaacactacaaaaaaataagaatatagcatataaaaaggatggcacataaaggcatttggaaaagaatgtagccattaaataatatatttaacctttggggggaaaatgaagttatccccttacttctaacaagcaacagcatggtttagccatctaaacaattaaatagttgaacaatcttaatatttaagaaagaaaaaagaaaccataacagaccaagaagaaagtatagatgaatatgacttgatctcaagatgaagaacttaggcatcaaagggaaggcagaccattaaggcaaaagcagaatattttaacaacatacaaatgaaacatttgaaacaaaaagaacattaaaagaaaattacaaattagaaaagcattataacactcattgcagattagtggacaaaatcctaactaacaaaaaactcctacaaagatatacaaacacatcgctaagattacatataaagacaggaagggacaatgcacaaaaaatatataaatagtcattcaatatatccaataaggttgaatttcactttcaatctaagaaattaaaacgaaatattatttccccttttaaaaatattagaaacaaatgatagtaatatctagtgttgtttgggtaaagcagatgctctcaaatgctgcagacaagaatgtaaattagagcattttgaaaggatacattgccagtatgaatcaagatccttaaaaatgtctacgtaccttggtctagtagttccatgtctggagagtaatcatatggaacgaatttggagatacacactaagatttatgtataagaatagtcatcacagctttatttataatagaaaaaataacaaaactcaataataaaagatgaactgaataaattacaacacatacagtaaatgcaatgccctgtaaccattataaattacatcttcaaagaatatttagtgaccatgcaaaatatttataagaaaatcaggatataaaatgctatacacacttgattcaaatcttccttcctctttttgtcttcatttacaaaaacacccaataactcagctatacttttcagagctagatatgtaatgtgtttaactgtttcagaaaatacataaataaaggtttacccaaatttaaatttgttttaattgctttataaaaataagagggcatatattattaatctccaatgtcttcttgaaaattagaaaaaatatattaaaaatggttcaaattttatattcaatagaattttcttggaaggtatatttaattgcattttcatactacagttgctgatggcaaaatatttacatccaccatcaattaatagactaaaaccaaactgaaaaaaaatttaaggtgtcactgtgaaagcaaaaacatctttttgtaatgttcttgatttctttctaactatgaaatatgaggaaaaatgtatcagaaaaaagtgaaaatagatttctgcccactgctcatattaatgcattatttctgaaacattggattgtgattgtttctgtttctcagtcaggaatcagaatacaccaaaggtggttgtgataggttttgatatgtggtagtccctcattgctgtttgccaatttccagccattatgaaggctaaaattgttatgttggtgataagaaaagagtaagacagatgactgggtgaattggataaatgtgatatatggaaatagagcaaggtaccatcactgtgcatcagaagatccacggctgcacttcaccggaaaaataatatcagtaacaataacaataagcaacgttattgtacactactgaatttcagtcaccttgacaatatggagtcatgctgaaaattataaaagatatccctttgttaatctgtttcaatgtgttttttaatatctgaagaaaactattaatatcagtagttatgtttttaatctaccaagaatcctcttacacttgaggtcaaagggtctactaatggatataaaaaaaatcaaagacaaagaaattactgatatttacatttttaggtatggcaatatagaaactaagcttctggactgttaaagattcaccaagcttagatgttacagagggttcaggaatgcttaaaacctacctctttgttgaacttcttgtcatattctatttataataaaaattacctgaaatattttccatgttagaacaaaaaataagccatttcatctttataatcctttatggtagtctgttatccagccagaaacttagaacagcagtactttttaatggcagtaacttaccgtggtagttataaccttaattctactttggtactttggtgtaagttggtcatctttgtttttagaaatattaagaaagctaggacttattattataacatttatctcaaagtatatttctttgataaagaaatttgcaggaacaggaataaatgtcacactctgtggttccatataataaccttctgccctttaaatcaatatgttttttcatgtttctttgaaaactaagaaaaagctcccctaggaagtgaccgaagtgatcagagtaccaacatattttcacaacgaaacaacagaaggataatcatacagctcctcctattcagaaggtcttctctcaactgccttctccctctcttttagtaaaggaaaacaaattttcctctcagggtttacccataggctgctaaagatacttattctgcatatctatgccttttgttatctgtaatggtggtagagacttgtgtgtccatcatttatatctggaaacacctgaagagatttggtattgcaggtttagagctacttatttgttgagcgcttaattggcaacttcaatgataatgaaagtagcttttttcacttattaagagtttggcagttgagaggtgatcagtaatgttggaaatagcaaggagcttggaactaaatatcaccttaatttcatctcagctctaatttacaggcactgtgatcctcagtgtctttatcagtaaatagctacttttaaaaaatgggggcagatattaaatgtgataaagtatgattgagtgacacatatataatgtatgttcagtaagtaggagtggtttgttttattttgttttgagacaaggtctcaagcaaaactctgtctcccaggctggagtgcagtggcatgatcccacctcattgcagcctccaccttctggactcaagcaatcctcacatctctgcctccctagtagctgggactacagtcatgcacccccacgcctagctaatttttgtatgttttgtagaaacaggctctcactatgttgcccaggctggtctcgagcaatcctcccacgttagccttccaaagtgctgggattacagcataagccactgcacctggcaggaaataggtttttaaatacacagttaaaatacaatagaaattatttaacaggatatacttcttatacattgaaaatttgtacccttcttatcaaaaacatccagaacatgagacaatttttaataaaacttgtctgaatgttcaagatggaagtaacaatttaaatatgtaactagtactttgtttcctcatttttcttatttgtaggctgaaattcaatgattttttttttacttctttaacatctctctttatgcacagactataagcttcatgagattagagaccagttctgtttttctccctgtagctttcccagtgcctaaaacacaagcaggcattcaataaatatttgttgattcaatgaataaaaacaaatgaacctgcttttagggaaagtgagtgatgcacgtgatgaatgtacacgaccaatgccactggtcttaatgactcactaacagctcagtgggagggaatgggagctatgagggctatgcagtcttccatgtcatttggtctcccattagcccactgaatccttattatcattattcatataaataatgtattaaatccattcatttttcatttataaatggctttggtacagagttgagaaaataataagaaaatgttcttatctataaaagataagaaaaatcatggaaaatgcccagccagtatctaccctgttatcatttggcttctcatgagacctccacaatgagttctgttggggtatcagtggcgtcgtgtggaaggacaagttagatctcccttctatacgaagaagttaggtggccagcgagttggaaacctgagaaaggggtagtttagctttatattttactatctgccacttcttttgaacagcatgggtggtgcttggggcctctggcactgttcccagaagcactgcccctgccaagcagaatttgcaccttcacaagtgctgattgactgtgagggaaagatatagaccccttctggaagcagctttctgggaaagatattatacctccagcctggttgtggggagggcccaagaaaataggactgtgtgtctggtactagtaggtagtggataatttaattcctttctcattacatccattcaatctaacatttattttgaagagttaagtttcctagacacagatcctaaaaaaataaaataaaatatgaaagcaatgaagttcctcctcttttattttctctctctctctcttttttttttttttaaagagcatcataaaaaagtttgttttgctggctaacagcagcgaaggtacaaagctttcttcgttagggtttgctatttaaaccatcagctcattctgcaagaacatcaaacatgtgtctaccagatgctgggcaacagcgcgatactaaggacttgactcaagtgaacaataatctgtggacagcgggtgtgaacccgagctgggccaacacctcatcagaccgaatggctaattgatttcaaaattagactcggtatttctgaacaataatcttgaaaggcagcaataaaatacatcaggatcctttgagctggccaagctttcatccaaatggcttattacaaagagctggcacacctgaactttggcacagtcaaataaatccaaaaacagcaaatggaaaccacatttggcactggaggtttgtcaagaaaaatttgtattcatgaggaaacatgatttttgattttgaaattatttgggggttatcggtgggaagtaattcattgaatatgtatttgactctgacagctatgatttatgcaacaaaatatgcacaataggtatgtgaaggcttttgagaatcacataatctttggaacaccaggatcagccagggcacagcaagggttagtgtagctccattggtgataacttaatcgcatgtgtaggcctacccctttgaactctgaataactgctttgtggcatcagggtccacaagggtttaaatctgactgcactgcaatgacaataaattataccaactatttaagaaatgcttggaatcttatcttgccttcagagtgagcaaactaagattacaattcctggcttaaaacatggcataaattctgagaacaaacacggaaaatttacacaatggcaagagtgtatttcactactcttctctcgcagcatttttttaggacctctaaagatacatgttgaaaggtccgttaaaaaagaaagaaagaaagagagaaagaaagaaagaaagaaagaaagaaagaaagaaagaaagaggcaaacaacagagtatgtctgggtgggtaaaatgaattaaaccactgactggttttctgcacaatgcttcttagtttaattttctggctactttaggagaaaaaattttgctattttctttgcatttcttatcctaataattgcctatatttttaaattttaattttatataaaggaagtctgcttaactggatgtatttgctaagccttttaactgctttgatagattctatccaaagatgacaaaatatctcatagagcgaagaagaagaaataacattaaggaaaggacacggaatcactagtattgatctaacccagaactcaaaaattacaaaaaatacagcaaagaattatcacgagaacaaaggtggaagggagtgaccttggaaaatttatctccaaatgaaaacatttctcccttcatggttctctcccttttctagggcaatccctctccattaaaaaagctgacaaccttttttgcgattctgactttttaaactaagaagtgacttggcccacagcctgtgctgagccagttagcgggtgactgccacttgggaattagcgtttagatatctgaaggaaggaaatcagaaattagttctagcccctgatctgttaattcactggatgatcttggacacattttcctttccggactgcagtttcctcatttttaaatgatgagaatggtactaaatgatctctaaggactctttcagttctaaaatattataaagctatgcaatagttccttcagttgatgaaaacaaggctggtgcatgcattgcttgaaagaaaacagaagaaaagaagtgtttagggtgtgatatttaataaatggaattaggacacatccaatggttttaggaagttgatttattacagttttcagcaaaatgatatagaaaactaatcaacaaaaatgttaacaataaagtacttcaatgaattggaaataattttttagctaaaattaaatagaaaaataccctgttaacgctactggtacagggtattagcaaaattctccaaaataaaattagtttctgggaacgcatcccccaaatcacattctccatttatctagttagccaatatattctgagtgttccttttgtaaagacaaatgaatattcaagtaccccattttttagagaatgactaataagggggtgttgaattctggagagttttagatatgatgatgactacttggtattctgtttatgtattgtgttagtataaaataaaaaaattaaagcatgtagttagtttcaaacttgtattaactctcaaacattggaatccaaaatcgtgcttaagttactaaaacactttcatgttctgttttcaaatccacatacctattcagaagttagaatgtatccatttcaatacctattcaagaaatgaaatttcactttgggaggccgaggcgggcggatcacgaggtcaggagatcgagaccatcccggctaaaacggtgaaaacccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagaaatgaaatttatattaacatggcggtcatatatatgatatgcgtatatatatatctttaaataattttatctgaaatcttagatcacaaatttgagaggatatctattttcatttcttgattatgtcttttgtatcatttaagtaattttaaaatattttccaaaaggacaataataacaacaataatatttaacaaatgtattagattacatttatgccacctgtatgccatgtgtcttaaatgcactgatttaaatttcacaataaatttacacggagggtaagctgtactaatgaggaaaatgagccaaaagagaagtaacttcactggtttacacagtggctttaaactgaccattatttaccaattccaattttccacaatactctgcattattactgcaatgaatttaatgagttcctttatttattcattcaacaaatattcactgaaggcctgctatatgccaatgactattctggacatagaggaaacaatgaagttacattctaggttggggggtaagaaaataagtaaatatataaatacataagattatttcagttagaaggtaagtggtatgagggttgccatgtctagctttgcaaccagtgactgtgagtgttatgaaggcaatatagcagaatgatgcaatagagaggaaatgcagattgattttagattaatagtcagagaaggctcctaggaggaggtgcatttgagttgagatttaaatgacaaaaatcatctagctatgggaaggccttgggcaggtacaccagatagagcaaataactagcagcaaaactttgaggcagagatgagttggctgagcataagaaacataaagaaggccagtggggataaagccaatgaaggggaacgggaatgagaggcaaaaggagtgtagacgggagggggttgggctctgtgtggcttcttagctatgggaaagagcatgcaatgtgttactaaaatattaatgtcaaacgacctttcagactattgccattaacctctgttttaatgacataaaacacaagtttgtgaacttttctgattctcagaatgcttggacatttgttgggggaggccatgaacccatcttccttggaaaaattcacatttatacagaaatgtgcacacgatttcaggagttaattgggatcacgttccccctggagcctacccatgggcccatggatttcaggtgaaaaaaaaatcacagaaactattttacagtgagctaaatgaattgtggtccttaaatcataattataatactcacctaagtaaacaatttctacccccaaaattatatagtccaggccataaggcaatctgccctataaggttaaatttctagtttcaaccacagagttgtactgtttttcaacagtttgacaatctcctttctacaattttgacattcaagagccaaattcttaatgctaaaaatatattttaatactcatttaccaacaaaatttgacctgcactaatgtgagattatttacaatgtttatttgtgctgcttatgttttatagcagaaataacgatgtgttggattacaaggtgatgcttcagtatcaccttgtgaggttacataatgtactgtgtgtgtgtgtgtgtgtgtgtgtgtgtgtgtgtgtgtagatacatatgtaggtgtatatatacatatgcacaccttctacttccaaaagaaaccaaaattctgaaaaccatgggtcctgaatatttttgagtaaagagccatcgacctgtatagtttcccatccttctgaaatatttcttgagtattttacgtcttctctgtgtattcaggataccaaaaataagtcagcacacagggctctaagcacttaacatccatctggtgtgttgacaggttttagatgacatcctagtgtttcctcagcgcagaccacctcaggagtaggaaggctacaggacattgtgaatgttctccctcagcatataaaagaaacacctgtaccaaattaatttgtgcttatccagtgagaagttcacagggtccctccgcctcttttacctatgaagggtggtctattgacttagctgctgtgcaaaacaaggccctgcagggagccctggcctctcgaggggattttctgggaattattcttcacgtactcctaagcttgtttctttctttgttttctacgttcttacttaaccttaatttatatagtctagctttgtattttcgaggcattatgccatcgttaaattgctaatacttaccacattgtttaaagcaggcatcattcctcatgtgcgacgcagagacccagagatgggttaagtaatttgctcaaggaatcagaatgggagtgaatgatgaggcttcaattagaactcagagtttcatatgtactgttcttttctcaggtctctggggcacagtgttattatctgggaactgatcccaaagaccaaactaagtatccctagctgtggtgcttcttcctaacatataaacacttctgggggaagaggatggaggaggaactgaaaagaaacaagtatcctcgtttccctaatgtatcaaattcattgaaacataatgaaggtattagctcttattcaatctttgtaaaatcatttcctcattattttaatatattttaacacagtcgtttaaaacctaactcaattacaccttaagaaataaaatattagataaaaacttttaatttcaacttttgttgaggtactttatctgttttctcttagataaattgctacattgaaaagtttatgattcattttttcaggtagtataaaatcagaaaaaaatgtatattttatcagtttctagtggatatctgctgaaattaaaatatttattttaatacaaacctaaaaatttgacatataacctaataacagaaggaggtaaaattcagaggaattaccctcttctaattttccccaatcccttctctcactgacagttctcttgtggatatctagtagttagttttcttcttcctctgtcctccctggattactgtaactgacctgtttccattgtcatgcaggttgcatctaggtctttcttaacctgtacttaagaccattagggtactctagaatctgctattgtatatgtaaaatttccatctagatgtatcccatgactccagaagtctactttgacaactcggttcagtgttttattttatgctgccttacttctccaacagtgccagtgacaaacattctcttgagtctctggacctccttctttttttttttttaaatatatatcatttacagaaaggcaatacatttctatgtataaaacgtttctcacatttcccactcccttagaggtccactaaacagcttcatctctcagtaacgttccccaaagtgccaccaacataattaccccatgttcatcattcataccacatcatctccattctgaaactcttttcaatggctttcaggcttatatctccccaaaatgggctgtataagccacttcattcagtcctcattctaatataacattaagtcttccctgaaacaatttagggtgtgactttttctccgatcatggcccaatttgttggtctctaagggcttggcagaactccttctgagcattccctagatttcaacttacacatgtcatagcctcttccattccattctacacattgtaattcttgccctttcatctcgaactcctacttccatcaagaagtctttccttattaacatgacatgccccaaatctctctgtttaccaattgtttattactgcagttttcatactttggctttttaaatttccatttggtaaattcttcttgttattctcacatctgtcttgcctttgtctcaaaggacaaagtctttaaagtttttatacctatttaatcttaaatatataatgacaattctatgctatgcccttaattatcttttgtttattcaaaaaactgttgaaaagcacgtcttgaaaaattcatgtacctttttctcctaggaaaacctcagtgttgatattggaggtcagtgtttcagaaggtaggtgctagagtcagatgtcctcgcactgcatccctagcccaaccttaattattagttttgcatactcaagcaacttcactttcctgttacccagtatcctcatcagttacaaaggaataatcataacacctgttccttaacatggatgtgaggttttaataagaaaatacacttaaggaattaaatggaggcttgcacatagtaactgctcaataaaatacaactattaccaatttattcaaaagtggatttcatttatgtatatttcaacatgctgacctttggaagaaggggtacagacagcagagtggaaaataatctactactatcttcaaaataatttgtattataaaatatttggtgtggttaggtattagttcaagttcttactttaattatagtgaatactactgataaatttcatatttttaatcatttagattaaatttagtatgcattggtctaaagaaaatttatgcacacagatataggaatttccctgtgtgttctcagtaatgaatatatgtaaacttaaatgttcttccttgatttggtcctctttaccaatccaaatagaaagtcatataatacagcattctcattctactagaacattatccataaaaactgattcagagaagtttctatatctctctcccagcaactatatttacatctaaattttcccaagacctatattaagtggaatgatcccacccagtaataaaacttcctggtaccatgcttgcagatagcctattatcaatttaatttaataatgttttgctatgcatataaaataaaaaccgacatgtcctaattccaatttttgaatatatttatagcaaatatatatacatttacatgggtaagtaaaataagccttgcaaatatcttaaaaaataaggagttattttcctagttaaggagctgaaggtcaaatacaagcagtttccttaagaagatcaagaaaggcttccagtcaagaccacagggtaagttgtgaatcatatcccgctcactggacacatagaaataatagaaaatataaaaactaagaccctctcctagaaggttaaagaaggaatcaaaagcaagacaatcatccataattttggttgccataaaaaaatacgttagactgcgtacattacaaatataatttttttgatcacacagtctggaggctgaaaaatccaagacaaaggtgccagcagattcagtgtctggtgaggactcattccccgtagatgatggcttctatgtgtcttcacatggtgaaaggagcaaacagtctttctcaagccccttttacagaactaatctcattcatgagggcagagcccttataacaataacttcccaaaaggtcacattccttaataccatcatattgagcattaagtttcaatgtatgaatctgaagagaacaccaacattcagactattgcagaaattgattaaaatcatagccaaagcacaaagctgtgggtcaggctgaggcctgggctagcagcagccagtagcagctagaagggaacagggtctaaaatgtacttaaaattaggttttggtgtagctttgctataagtgaataaaagccccagtaagccacttaggaatcaagactgattggaagatatgagactagaagatgtaggaggaccttgagaatacagatgttgtcaggacaggacaagaaccaagaccattcacctttgaccttggcgatttgacatatatatccctggtatcactaatgactagggatgctaacctaatgatataaagcaggatgctataccatatggaggcagccacctaactctacaaagggaggaaaagacagggagaaaaagaaaaagagtacactgcaaattttccttcgtttttcaactccaaaacacacaaagaaatcctttgattgggaagacagttgacaaacaatataaattcattttacaaaaaattaaaatagtatcacataaaaagatgatttaagtacatttaagctttccaaatacatacaagaaaataaaccacaagatgaccatcaatgatagactggattaagaaaatgtggcacatatacaccgtggaatactatgcagccataaaaaaggatgagtggggtttttttaaaaatttttttttattatactttaagttttagggtacatgtaaaggatgagtttatgtccttcttagcgacatggatgaagctggaagccatcattctgagcaaactatcacaagggcagaaaaccaaacatcacatgttcccactcataggtgggaattgaacaatgagaacacttggagacagggcggggaacatcacacaatggggcctgtcgtgaggtggggggatgggggagagatagcattaggagaaatacctaatgtaaatgatgacttaatgggtgcagcaaagcaacatggcacatgtatacatatgtaacaaacatgcacgttgtgcacatgtaccctaaaacttaaagtataataaaaaataaataaaaataaaaaataaaataaaatgcaattttcaaaaaaaaaaaagaaaccacaggaaaatttgtgaaagaaaaaatcagaaaaagaagaaaagaaatgaggaaaaaataaaaagtcacatataaaattcaaaataacagaaataaaagattataatggaaatgactcaatagtatagataaatattagactggacacagtaaaagaattagatggtacttcagtgaaagcacagaacttagttcagagagatagaaaaggtgaaaatacataaacatacatttaatagaaaagttaagtgacatggagagctgcaataggtgcctattatatgtttttgaaagtataatggagtgaattgtatgaaacaacattataatttacagtctctgaaaattttccaagtgaaggaaatagataaaataatgaattatatgactgcaaatgtactcgaactataagcaagataaataaaaataagtacattaaaacatattatagtaaaaatgtagaaacaaaaaggtaaaaagaaaaatcctaaaagccatcacatagaaaaaaaaatactgttaggaggaaaacaaattgcaccagtatcaatagatgccagaagacaacacaataatatgtttaaggatgtaagaaaatagagttcttcaattaaaaactgttatcctggttgtctgtctttggagattaaaggtacatccatatattttctgaaataggataaaggaaagtatctaccacaggctttttcttaaaagaacaaaacagcaaaatgaaaagtaaatcttgaaggaaggaacaaataagagacattttgcattgtttaacttgttagaaaagtttataatcttgtgtgtgcccattaaatgcaatcaataacttccaaacacagaaaaaataactgagtataacactgtcaagcaaacataagtcaggtattatcagataaattttgattcccaaaattcatatgcggaagacctaagccacagtacctcagaatgtgactgtatttgcagataaagcctttgaagagccgattaagttaaaataaggtcgtgtgggtggggccctaattaagttaaaatgagatcatgggagcggggtcctaatgcagtgtgactggtgcccttataaaaagagaaaacttggacaagcaagagagatatcagaaatgcacacacacagaggaaagatcatgtgaggacacagggagaaggtggccatctgcaaaccacagagatatgcctcagaggaaatcaaaccagctaacatcttacttttgggcttctaccctccataactgtgagaaaataaatttgggttgtttaagctccacagcctgtgttattttgttatggtaacactagcaaactaatacagcaggaaaggaggggagagaagcagcaaatgattgataaacagatacaagttgatatattaaatgatataatgaagtcaatataataaattcataatgatgttgatataatgaagtttatgtaaattgatgcaatgaagtccaaatatataagcaattcaagtaaattaatctggcataccgtaagagattagcagatggatttttttaaatccactgcatgatgtttacaaaacacacacacttgaatacatgtacatacacacacaattgcaactaaaacaaaactgcagagaaaatttgcaaatatagtgatgaaaaatatattatgcagatattagatgagtttgatacagcaatgttaatatcagacaaaataagcttaaaatgaaaaaattattactatgaatagtggcattccattattttaaaaagaaaaataaatcacaatgttatcatccaaaatagatttctacttaaagaaaaattgtcagaattgcaaggagaaattgacaagttcatagtcacagtgagagtttttattatacccacaaattgacaaaataagacataaatgatttaaacaacaaaaataacaaaagcaccttgaagccaataagtggaaaaggtatatttatttcagcaatttgaaacattttcaaaagtgggtaacatgacttttttaaaaatagattttagtttttcagagcaattctaggttcaaagcaaaattggatgaaaagtacagaggtgtcccatgtacagtagtggatgcctgaaagcctggatatacctaaccctacaggtaatatgttttatctgtatgtacatacctatgataaagtttaacttatgaattaggcacagtaagaggttaacaataactagtaataaaagaacaattataacaatatagtgtaataaaaattatatgaatgtgtgctctctctctccctcaatgtataatatttttggaccgcatttgattacaagtttctttttcttgttttattgactaggattattaactaggacttctaatatgatgttgaaaagcagtggtgagacgttcttgccttgtttctgatcttagtgaaaaatcttcaagtttctcactattaaatatgatgttagttgtaggtattttgtagatattttgtattaagttgagaaagatcccccccgttctttgtttactgagagtttttatcattaataggtgctggattttgccaaatgattttgctgcatctactaatatggtcaagtgattttcttctttatcctattgatgtggtagattatattaattgatttttgaatattaaatcagccttgcatacttgggataaatcccacttagttgtgatatataattctttttatacattgttggattcaatttgctaatattttattaaggatttttgcattatgttcatgagagaaattggtctgtagttttctaataatatttttgcctactttgtgtattagtataatgctggcctatagattaagttaggaaatatttcctctacttctatctcttgaaagaaattatatagaattagtacaattcctcctaaaatcgttagtagaattcaccagtgagcccatctggcctggtgctttctgttttggaaaattattcagtattaattattaattaagttcaatttatttaacagatataggcccactcggattgtctatttctcctagggtgagttttggcaggttgtgtgtttcaacaaattagtctatattatttatgttataaaatttgtaggcatagagttatccataatattactgtattattttgttaatcactatagaacctgtaatgataccctatctttcatttcagctatgaatgatttgtattcttttttctcggttaggctggctagaggcctatcaattttattgatcttttaaaaaaacaacttttggtttcattgatttttctctattgatttcctattttcaatttcatttatttctttgctattgtgaatactgctgcaataaacatatgagtgggtgtgtctttatagtagaatgatttataattttgggggtatatatccagtaatgggattgcctggtcaaatggtattcctggttgtagatccttgaggaatcgccacacagtcttccataatggttgaactagtttacactcccaccaacagtctaaaagcattcttatttctccacatcctctccagcatctgttgtttcctgactttttaatgatcaccattccaactggtgtgagatggtatctcattgtggttttgatttgcatttctctaatgaccagagatgatgagttttttttcatatgtttgttggctgcatatatgtcttcttttgagaagtgtctcttcatatcctttacctacttttggatggggtttttgttttttttcttgtaaatttgtttaagttctttgtagattctagatattagccctttgtcagatggatagattgcaaacattttctcctattctgtagattgcctgttcactctgattataggatagtttctttcgctgtgcagaagccgtttttagtttaattagatcccatttgtcaattttggcttttgttgccattgcttttggtgttttagtcatagtcattgccaatgcctatgtcctgaattgtattgcctaggagttcttctagggtttttatggttttaggtcttacgtttaagtctgtaatgcatcttgagttaatttttgtataaggcgtaaggaaggggtccagttctctgtatttcctgaatttgaatgttggcctgccttgctaggttggggaagttctcctggataatatcttgaagtgtgttttccaacttgattccattctccccatctctttcaggtactccaatccgtcatagtttcgttctttttacatagtcccatgtttctcagaggttttttgtccattccttttcattcttttctctctaattttgtccaattgtcttatttcagcaagatagtcttccattttttatattctttcttccccttgatcgatttggctattcatacttgtgtatgcttcacaaagttcttgtgctgtgttttcagctccatcaggtcatttatgttcctctctaaatgggttattctagttagccactcctctaaactttatcaagtttcttagcctctttgcattgtgttagaacatactcctttacctcaatgaggtttgttattatccaccttctgaagcctacttctgtcgattcatccatctcatcctccatccagttttgtgcccttgctgaaaagttgttgctatcatttggaggagaaaaggcactctggccttttgggttttcagcatttttccattgattctttctcaccttcatgagttcatctatgaaatcatgtgcaaaatcacaagaattcctatacaccaatagacaagcagaaagccaaattgtgaatgatctccaattcacagttgctacaaagagaataaaataaataggaatacagctaacaaggggcatgaaggacctcttcaaggagaactacaaaccactgctcaaggaaataagagaggacacaaacaaatggaaaaacactccatgctcatggataggaagaatcaatattgtgtgaatggccatactgctcaaagtgatttatagattcaatgctatccccatcaagcttccattgactttcttcacaaaattagaaaaaactactttaaatttcacatggaaccaaaaaagagcccatatagccaagacaatcctaagaaaaaagaacaaagctggaggcatcatgctacctgacttcaaactgtactacaaggctacagtaaacaaaagagcatggtactagtaccaaaacagatatatagaccaatggaacagaacagaggcctcagaaataatgccacccatctacaaccatctgatctttgacaaactggacaaaaacaggaaatggggaaaggattccctacgtaataagtgatgttgggaaaactggctagccatatgcagaaaattgaaactggacccctttttataaaactaatataacattgatcctcaaatcacattcattactgactttttaaagttctgagtcaaaactacaggaacagttttctaaccagacaaaacaaacttatctaaaaactgtagtaaaattcatttcagaaatgatggtgtgagagtatgacacataatttcccaagaacaaaaaatttaccggctaaaaattattttaaaacaaatatttaaagtttctgtaaatttgccaaggagaaatcttcttcaaatagcaaatgaagaaacatatattcaaaaagatttaataaatcttaatatgatcagtgagaatctgtggcatttgagccatgacccactcataactccttcctccagctcagtgtgttaacagttttactcttggcatgtgcagccaagaaggtaggggtctctctccaccttgcttcccacacagagatatggtttcatgctgggagggacagaccactagcatttttcatccctatcttctgttccatatttcagaagcaatattccagacagacatggctgaaagaatctatctcccttcctcctctcaacccccactaacagagaagctctaccagaaggagcgtaggctgagaatacaaggccttaaatgcttccatcaaaactcacttgtaaatgagagaaaatattcacaaatatccacaagctatgcatagacaaaggtccaatttatccagcatctataaggaaattaaacaattcaacaagcgaaaaacaaccccattaaaacgtgagcaaaggacatgaacagacacttctcaaaagaagatataaattcagccaataagcatatgaaaaaaatgctctgcatcactaatcaatagtgaaatgcaaatcaaaaccatagtgagacaccatctcacaccagtcacaatggctattattaaagagtgaaaaaataacagatactgacaaggctatggagaaaaaggaacacttacatgtggatggtgggaacgtaaattagtttagccattgtggaaagtagtttgaagatttttcgaagaacgtaaaacagaactaccatttgacccaggaatcctattgctgggtatatacccaagggaaaataaattgttctgccataaatacacaggcactcacatgttaattgcagcactattcacaatagcaaaggtatggaaacaacaaatgtgcccatcagtgatggattagattttgttaaaaaagtgctacatatacaccatgcaacactgtgcagccataaaaaagaactagattatgtcctttgcggggtcatggatggagctggaggcaactattctaagcaaattaatgcagaaacagaaaaccagtactgtatgttcttaggtataagtgggagctaaacattgggtactcagggacataaagatgggaacaaacactggagctagagagggtcgagagagagaggcaaaggctgaaaaactacctattgggtactatgttgactacctgggtgacgggatcatttgtacctcaaacctcagtgacacacaatatactcatgtaacaaacctgcgtatgtactacccaacctaaaataaaagttgaaaattttgaaaagtcaatgaatgctacaaaagtatttttataaaaataaaattaaaataaaataaactcacgtgtaaagattccatactagtaggagcaatttaagaagaccagggtagacagggcatggtggctaacatctgtaatcccagcacttggggaggctgaggagggtggatcacctggggtcaagagttcaagaacagcctggccaatatggtgaaacctcgtctctactaaaaatacaaaaattagctaggcgtggtagctctcgcctgtagtcccagctacttgggggaggttgaggcaggagaatctcttgaacccaggaggcggaggttatggtgagtggagatagtgccactgcactccagcctgggcaacagaacaacactccatctcaaaaaataataataataataataaaagaaagaccagggtctactgttcccacccaaagctctgttcatagagcaggggttttactctgagagaagtgggtctcttcttggccagagttccagagtctgtgcctaaggggaacaacagattataagaacaaacaatgccacaactgtgcttaagagaactgactatacttggaacagagtatgaggaagtccgtgccaaaaggtattgtggaaaacaatgaagatattgatgctgagcagttaagaggtggctgataccagctgatcatttctaattcaaaaacctgaaatccaaaatgctccaaaatctgaaactttgagcaccaacataatgccacctatagaaaaattcacacctaacctcacgtgataggccagtcacgactttgttttatatgcaaaattatttaaaatgttatataaaactaaattcaggcaagtgtgtaaggtttatatgaaatgtaaatgagtgttggtaaaggtaattataaaataattgtaaaagtatattgcatatttcttttctttatgaatcaattcatttaaaaataaattttataagacaatatgtatacaactattattggacttataaaaaatgtaatgcacttggcaaccacagcaaaagagacatggataaaaacaaagctgtgtcacagcacaaaaatgacaccagatggcaactagaattcacaaggagaaattaagggaactagaaattgcaaataaaatgcaaaataatgtaacaaattccataaatatataattgtcttcctttcttctctcaaaatatataaaattctagtaaaaattataactaaatttttggataggttacacatatagacttaaaatgtacaaaaatagtagcagaaatgagggaaggaaataaaatttgataagagtaaattgcattttcctatgattaagttagtgtaaatcagaagtagattccgataagatgtttttgtactcttggaatgaccattaaatttttttaaaaatgtattttaaaatcattaaagaaattaaatggtacactagaaaatattcagttaatacaaaagatggcagtaaagcaggaacaaagaaaaaatatgagatgtagaggaaacaaaaaacaaaaattcaatcataccaataataacattaaagtgaatgtattaacaatccaatcaaaaggtagaaattgtcagactggagggaaaatccagatccaaatatatgctgtctaaaggagacacattctatttatttatttatctatctattttccacttttattttgggttcaggggtacatgtgcaggtttgttatatagctaaattgtatgtcacaggaatttggcatacagattacttcatcactcacataatcagcatagtacttaatatgtagtttttcaagcctcatttcctcccaccttccaccctcacgcaaaccgtggtatctgttcttcccttctttgtgtccacgtatgctcagtgtttagttcccacttataagtgacaacatgtagtatttggttttctgttactgtgttagttttttaggataatggcctccagtttcatccatgttgctgcaaagaacatgatgtaattattttttatggctgtatagtattctgtggtgtatatgtaccacatttttttaacccagtctattgttgatgtgtatttaggttgattccatgcatttgctattgtgaataatgctgcaatgaacgtatgtgtgcaggtgtctttatggtagaacattttcttccagtaatgggactgctgggtcaaatggtagttctgttttaagttctttgagaaatcaccaaacttttttccacaatggctgaactaatttacattcccacagcagtgtataagcatttccttttatctacaacctcaccagcatctgttagtttttggctttttaacaatagcctttttgacttgtgtgagatggtatctcattgtggttttgatttgcatttctctaatgattagtgatattgagcgtttttttcatatgcttgttggctgcatgtcttcttttaaaaatcgtctgttcatgtcctttgcccactttttaatggggttgtttgttttttgtttatagatttaagttccttatagatgctggatattagacttttatcagacgcatggtttgcaaatattttcttgcattctatagtctgtttactctgttgacagtttcatttgctgtgcagaagctgtttagtttaattaggttacaattatcaactgtggttttattgcaattgcttttggggtctccatcatgaaatccttgacaagtcctatgtccagatggtattctctaagttatcttccagggttgttatagttttaggttttatgtttaagtctctaatccatcttgagttttttatatggtgtaagaaaggggtctagtttcgatcttctgcatagggctagccacttatcttagcaccattgattgaatagggagtcctttccctattgtttgcttttgtctattttgtcaaatatcagatagttgtaggagtgcagctctatttctgggctctctattctgttccattggtctactgttgatgtgcatttaggttaattccatgcatttgctattgtgaataatgctgcaaaacatctgtttttgtaccagtactatgctgttttggttattgtagccttgtagtatagtttgaacatgggtaacataatgcctccagctttgttctttttgcttagaattgccttggctattcgggctcttttttggttccatatgaatttttaaacagttttttctagtgctgcgaagaatgtcattggtagtttgataggaatagcattgagtctgtaaattcctttggccatatggccatttcaatcatactgattcttccaatacatgaatatgaagtgtttttccatttgtttgtgttatctctcatttctttaagcaatattttgtgattcacagtctagagttcttttacctccctttttagttgtattactaaatattttctatgtcaattgtgaatgggattgccttcctgattcgcctcttggcttggttgttgttggactgttggaatgctagtgatttttgtacaataattttgtatactgaaacttttctgaagttgtttatcagatcaaggagctttgaagtaaagactatggagtttcctatacatagcatcatatcatctgcaaacacggttagttttacttcctctatttcaatttgaatgccttttatttgtttctcttgcctgattgctctagctagaacttccataactatattgaataggagaggtgagagagggcatccttgtcttgttccagttttcaaggggaattcttccagcaggcgagacattttaaattcaaagatacaaatagatttaaagttaaaaaagaaaggaaaataatatttattgcaattactttgctaatatcagacaagataaactaaaataaagtgtcactagtgaaaaagatgaacatgaacattttataatgataaaatagtcatcttaaaatatatatatatttatttatttataaaattacagaggaccagaatacatgaagtaaaagctgacagaattaaaagaagaaatgcatgattcaacaattatagctggaaattttaatattacactttcaaaaatgtatagaacaaaaaagattaataagtgtatgaaagatttgaaaaacattgtaagccagttatacctaatagacatctagaatactgtacctattcttttcaagtacactttggaacatttgtcagaatagatcatatggtaggccataaaacaagcctcaataaatttaaaaaattaaaatcatacaaagtaagttattttaccacaatggaaaaaaattagaaatcaataacagaagaacaagataagggtattacttttgccatattatcttacactgtaatggaggttctagctatggcaatttggtaagaaaaagaaataaatgcatctggaatggaaatgaagaaataaaactgctgctatttgaagataaaccaatcttatacataaaaaattttgagcaatccactaaaagcctattgaaattaataaataaggtcagaggggctgcaggatacaagatcaatattccaaaatcagttttatttctcttcactagcaatgaacaatctggaaaataaattcagaaaacaattgtatttgtagtagcatcaaaaataataaaatacttggaaagaactttataaaagctatgcattgttaaaagaaattaaagaatatataaataaacgaaaagacattcatgttcatggattagaagacaatattgttaacgtgcaatactccgcaaattgatctacacactaaacataaatgtctataaaaaatcccagctggcttttcatataataaccctaaaattagtatagaaatgcaagagacatcaaacaaccaaaaccatcttgaaaaaaaaatgcaacattagaggattcacactttctgatttaaaaaacttactacaaagctacacagtgcaaatattgacataaatagacatccagatcaatagaatagaattgagggtaaaccttcacatttatgatcctttcattttcaacaccaatgacaagacaataaaatgggaaaagaataataatcttttcaactaaaggtgctggaacaactggatattcatatgtaaatgaataaagataaacccctacctcacaccatccacaaaaattaattcaaaatgaatcatagacctaaagaaaaaataaagtgtgcttcctcaaaattgtaaaagtgtgtgcatccgaggataacatcaagaaagtgaaaagagaggagaaaatatttccaaattatgtatttgataaaaagcttttatccagaacatataaagaactcttacaactcaacaataaagaggcaaataactcaatttaaaaataggcaaaggatttgaacagttatttctcaaaaaaagataacaaatgggcaataatcacatgaacagatgttcattattagtcatttgtgaagtgcaaaccaaaaccacaatgagataccacttccaaaacactagattactaatcaaaacaacaggatatgaagaaattgggaccttcatacattgctggtggaaacataacaagacatatatagcatctatggaaaatagttcagcagttccttagaagactagccatagaattatcatattacccagaaatttcactcctgggtgtatactcaggagaaatagaaacatatgtccacaaaaaaattgtacatgaaaaattgtacatgtttatagcagcattattcacaataagcaaaaagtagaaacaatccaaatatccattaattgttgaatggatgaataaagtatggtataatcaaaaggaataaaaatctgatacatgtgcaacatagatgaaccttaaaaatcttatgctaagtcgaaaagtccaaaaaccagtcacaaaacaaacagtttttgcatcaatcctttttatttaaagtggtctgagaaggcaaatatatagacatgtcatgattaattttttgtgtcaacttgactgggtaaagaaatgaccagatatctggtaaacacatttttggatatgtctatgagggggtgtgttaggccatgcttgcattgctttaaaaaaaatacctgagactgggctatttattttaccttttttaaaaaagaggtttaattggcttaagggtctgcgggctgtgcagtaagcatagcagcatctgcttctgcggaggccttggaaaacttaaaatcatggaagaatgtgaagtgaaagcaagcacatcatatggccagagaaggaggaagagatagtgggaggaggtgccacacatattttaatgaccagatctcacgtgaactcaaagtgagagctcatttatcaccaagagaatggccaaagctatccatgacaaatccacccacatgacccaaacacctcccaccaggcctcacatccaacattgagaattacatttcaacatgagatttgggtggggaccaatacccaagctatattattccaccccgacccctcccaaatatcatgtccttctcacattgcaaaacacaattatgccttcccaataattcccccaaagtcttaactcagtccagcactaactcaaaagtccaaagtcagatctgagataaggaaaatctatgagcctggaaaatcaaaccaaattagtcactctcaagatacaatgggaatataggcattaggtaaatactcctttttcaaatgggagaaatcagccaaaagaaagaggctacaggtcccatgcaagtttgaaacccagcagggcagtcattaaattgtgaaagtccaaaataatattctttgactccatatcctgcatccaggtaacactggtgcaagggggtggactgtcaaggaattgggcagctccatctctgtggcttttcagggtgcaagccccgtgactactctcatgggctgcagtgagtgcagtgcttttttaaggcacaaggtgcaagctgccagtgaatctatcattcttgggtatggatggcagtggcccccttctcacagcttcaatagggagtgccccagtaaggactctgtgtgagagctccaatctcacatttccccttggcactgccctagtaggggtcgtctgtgggggttctgcttctgaagcaggcttctgcctgaacacccagccttttccatacatcctctgaaatctaggtgaaggctgccaagcctcattcagtcttatattttgggtgcctgcaagcttaacaccatgtgtaagccaccaaggctcacagcttgcattcttcaaagtggcagcttgagctgtacctgggccctcttagagccccagctggagctggagctggcgtggcctggatttggggagcagtgccctcaaggctgtttagggcagtggggccctgggcctgtcccacaggatcattcattcctcataggtctcaggacctgtgacaggaggggctgccatgaaggtctctgaaatgcctttgaggcctttttctcattgtcttggctattagcacttggctcctttttagttacacaaatatctctagcaagtggtgactttacagcctgcttgaattcctctcctgagaaagctttttctttctctgccatatggccaggctccaaattttccaaacttttgtgctctgcttcttgtttaaatgtaaatttcaactttaggtcattcctttgctaccacagctgagtgtcagaagcagccaggccacttcttgagcactgtgcggcttagaaatttcctctgccagataccctaaatcatcactgtttcgtttaaacttctacagatccccaggacagggacagaatgcagccaagccctttactaaggcataacatatgtgatctttgtttcagttcccaataagttcctcatttccatctgagacttcagcactctggccttcactgtccatatcgctattagcattttggtcacaactatttaactagtcctaataagttccaaactttccctcagcttcatgtcttcttttgagccttctaaactcttcccatctctgcccattatccagttccaaagcttcttgcacattttcaggtatctttatagcaatgttacactcctttccaaacagaaattggtaccattttttttttgtgttaggccattctggaattcttttaaataaatactcaagacttggtgatttatttggtttaattgactcaagattctgcagcctgtagaaagcatagtgacgtctgtttctggggaggcctcaggaagcttacaatcatggcagaaggtgaagggggagaggtacatcacatggtcagagcaggggcaagagagagaagtagagagcagttaggggaggtgccacaaacttttaaatgaccagatctcaggcctgtgaactcagagcaagagttcacttatcaccaagggaatggctcacgccattcatgaaggatatacccccatgacccaaacacctcccaccagagctcacctccaacattagagattatatttaaacatgagctttgggcaaagacaaactataccaaaccctatcatgtgcttctgaaagagattagagtttgagtcaatggactgagtagagaagattcaccctcaccaatgtgggatgatatcctattcacaaagggccccagtacaacagaaaggtggagggaaggtgacttttctttctctgtttttgagctacaacatccctcttctcctgacctgggacattggagcttttggttcttgggcctttggagcctgggacttgaaccagcagcttcccaggtcctcaggctttgggcctcagactgggagttataccatcagctcccctgttttttaagactttggatttggactaaattacaccactggcttttctggttctccagcttatagacagcatattatggaacttcttggtctccagaataaatatccacttacatatctgtatatattctattggttctgtttctctggagagccttgactaatacacagccaaaagtagggttcatggttgcctagggctgggatgtagtgagaattggtagcaactgccaatggacatggggtttctttttgaggtgaaaaaaatggttttaaaattagattgtgctgatggttgcatagagaatatctccgcaatattctatacttttattgcacacatttacaaaagtttcaaggattttataaatgatatattagatggatcaattttccctcagtgttatgttttgaaacttagccatgttaatacaagaaacttgagttttatctactgtatgatttttccttatgtaaatgtaacaaaatttacttatccatctgcttatacagatggacatttcagaaggttttaaaagctgccaccatagatatttctgtaataaacatcttggatatgttccattataaacatatagatgtgtttctctgggatatatacactagaaataaaactactgggtcataaaatacataccatctttaactctgcttgatattactacatacctctctaaataaaagcagtttgcttcacattcttgccaatagttgtttgggttagacatttcaaggttttgcaaatctgatggagtgggaaatattatgtctttgtggttgttatttgtatttccctaattactacaaaagtttaatgtttgttaatattaactatttgagttcccccttctattatgtattcacaccatatttatatttttccattgggatctgtatctttaaatgtttggagttctaaatcctgggagttctttaaatgttttagatacaaattctttttttgttgtgcattgttatgcatatgtattgcattctggcttgtcattttattttataatgtcttttgttaaaaaaagagttttggttggggtttggtggctcacacctgtgatcccaactctgtgggtggctgaggcaggagggtggcttgaggccaggaggtcgagaccagctgggaaacacagtgagacatcatctctacaaaaattttaaaaattagctgggcatcgtgtcgcatgcctgtagtcctagctattcaggaggctgagatgggaggatctcagagcaacttcaagacaatatttagagttggaaatggaagggagaaaaggaagggaatgtaactagaaaagttcagagagggtttttaatagatctaagatattttccttttcttaaacatttttgatgcaaatttagcaaaatgctaatcctgtttttctattttttttttttagagacaaggtctcgctctgttgcccagcctggagtgcagtgacacgatcatagctctcctgggctcaggcactcttcccacctcagcctctctagtagctgggactacaggcatgcaccaccatgctcagctaattttttgtatttttgtagagatggggtcttgctatgttgtccagactggtctcaaattcctgggctcaagtgattctcctgcctcagcctcccaaagtgctgggattacaggcatgagccgctgcgcccagcctaaacatttttaaagttggagagtgacctcatggtattagttagactataatcctctataatttctttcattttgagatttttcaccataaagatctttaaagtaaaattcatttaagaaacacaataacagtgaatatattcaatattgtatggtggaaagcaaatggactttgggatctggcacatgaactgtgcatccttgagaaattttttaacctatctgaacatcagattctccatttgtaacatgacggataatcacacttgctggctggtgaaattctgaagggtaaatgagttggtataaaaaatatgtgcctgatatctctaataagtgcacaataataaatattaattatcttatcctggaaaatttactacttcaatatgaacatatgcataattgctttttatcatgtcctgtaatgttactgaaaaaaatcattgctgaatttttcagcagtgaatatcagcctggaatatattcggctccacaaaaagaattatatcttgctgtggaatggtgtgttgactctatgatggcttcagggatctgaatctcttctctctttctatccagccatcttcagtaggtagttttgtctctcacaccctttatttctagtcacgaaacgacagttccacatctagcattatattttcagcctagctatgcaaaagagaaagggcaaagtcagctccccctttttaaataattttccaagaagtcttacccagggtgttctggttacttctcattggctagaactgtgtcacatggcatctgtcatagcaagagaggcctgggaaggtgatcttggagctgggtgtgcccctggaaaaagaaaatgaggttctgttagtaaggaaaatgaggagaatgaaaagtattaagtgaagaaattgcaaagacagcatcagagactgccattttatgcattccacaagaacctccttttttttttttttttgagacagagcctagctctgtcacccaggctggagtgcagtgctgcgatcttggctcactgcaaccttcgcctcccgggttcaagtgagtctcctggctcagtctctcaggtagctgggattacagggacccgccaccacacccagctatttttttgtatttttaattgagacagggtttcactgtgttggccaggctggtctcgaactcccgaccttgtgatctgcccgccttggcctgccaaagtgctgggattacaaacatgagccactgcacctggccaggacctccatattttgagtcaagatttctttttctggtgtgtgatggcttcagaattcctacctagaaatgattttaggatgacaatattgaaggaaatgagtttctttaagtggttttatttaagcctatgtgcaatgtcagtacagggcttttgctgaaatggcatgtttatttggggcacttggtgtgggcgtgagagaagtagttgatggagctgacgggtgaggagaattcgaagtcctctatagtcttcagctgaaccaccgcttctaataaatatgcttttaaatctccagacacaaacacttaaaatcgagctttctttgctcttgcagtaaatcagtaaagtacaacgctcacaactattattaataatgcttcttcatgagggggactaactggatttggcagaattgtgctttttcccttttagctgctttctttctcttctcacggtattataggaagaaactattagaactaattttttttaaggagaaaaaaacaatacttctcctaagagggaccttgcctgaagcaacctcttttatatggtgcttcctaaggcagtaagccagccttttacagacatggccagcacaggtgtggcagagccgcactaatgagcagcatatgcttttagttacattctcattatggtgtcatcagggcccaagaaagcaaccatattacacgtttaagtttttaaaaatggaaagatgctggggctcctttaattttaaatattctgggaatcataattgaaatcaaaacttctttgaactattgtggtgtaccccaattacaggaaatcacttaccagtgaaaattacacggagaaagaatattttcaattctatggaaaaggggggaaaacatttttctttaatgttggtctagtcgggaaaacttgaccaaccttgtctctagatccaaagattggtccaatgcattgatctttatgtaaattctgttaatattgaatggcacttaaacaaggtcaaaaatgaaattccattaatgactcacatcaagttttagcatcaatggacactgcaaaccaagccttgggctccttaaaattctaactggctcatttaaagtcaacctcagaagttatcttggtttcatttggatccccttaccatcagaggtagtcatgaatgattcttcttgggggactgatgtgaatctttaaaatttattcaccaccacaaacagtatctgagttcatatgaactgtcatggataaggaaatgtgcctgagttccttattgtactcacacaacataatgaagacacacaattcacactcatgccattttctgctgcactaaagtttgaaactgtcatagatgctaatgcatgaaaaaagtgcaaagtgcttccacttggatttttagctccaagccatttggcagtgagttgaagggagtaagcatactgacaagcaaatgtgttagccttttatatcccattttgagagttttgggtgtgaaaaaagtgggagaaaatggaagattatacatctactattctggactgttgagttccttccaatggagaatgatgatgtagaaactgcaaagcaaatctctaggggatgggatgaggtcagacactggatcccaatcctagcatttagagcaaaagcagagtgggagccaggccagtcacaagctagacagctggcagaagatgccaaaccaaagctgggcaggtgcaagaaccagagtcctggagcacatttaaggttataacgactagagttaaagaggaggaaaggaaactaagaaatactcctcccaggcgacgttctttgtgggagtttctttccaatccctaaatgccatgctgcctctggtatgcttggagcagcatttgataacatttcatcagctgtcgtgtcctgcacacacctttccagttttgacacatttcacacagttatcacacccactgtcctcagacaagtttatgtgcttcagacaaaccaagctgtgctcatacatgtttatatacctgcaattgacaagaatgaggcatctggaagacttgtggcagctaagaccagaaaagagctctgttccttctcctcctctctttggaaattgatgccctttcatcttcccatcttaacacttattcttccaaatttttcattctggcttaagccaagataattcttgcaggagccaaatctctcatctttgactcaacctcctcccctttcttttttccatggaatctcatcaaatctgccaatatcttcttttgaagagcttctgaatttatgtttttcttttctctctcactctcaccaccttgtctagaccctggtcacatcaaacctggattgttttaacattaactcttctcattagatgtgctggttccagcctttccagccctgacctattcacacatcaatccccagcgcaggggttcctgagaggtcccattgcctataatgctaagtgtacactcctcctgccactctcagtatctggcccaccttctctatccaatcacatttctctcctactctttcttatcactcatctctctatctccagttttaccatttcccccacttctactaatcaattttctttgcttaaaatgtctccccattcgtcctcagctatccaaacactagctatccatctaagttcatgccaaattatcccccactaagtcttctctgaaaaattgggtccctttcaattccatagttctaactgccaatacttcatatttctgttatctagaagattatgttctgactcgaggttacttaatgcttgttttataaacctgtttgcctccttaactctttaacttttgagagcattgtcttgatgatacatttctcctgcattgagctttttcccctttggggaacacgctgtggaaaagtagacacccaatagatgcttaatgtacatatttataaaatttgtctgggaacaaagatttaaaaaatttatattaaaaaggactctgggaaagtcagcttgggatttggagagttttaaacattttatgcacagaattagtttaaagacacaggactgaagtatcctgctccctctgacctttgggctggcagcaatgctggcaatattctactctttcatttttggcccttcttccacagctttctgggctgcttaattggcctgcattccaacttcatcactggaatgtaagctatcacctacacacttaagtaaatagttaaatcgttcttctggctttaccaaatggaacagtggtttccaaaaatgggactccacagctctgccatgtccttcgttacttgggaaaggttctgttataatctccttgcatccctacactgaatttactttcttcttctctgaaaataacactaaagtaaggcaggggtaacactaaagtaaggcagagttcattggaaatggaaggatgaagaacatttgattttaaactgagaaaagttttcattctaaagaacttgaggccgggcgcggtggctcacgcctgcaatcccagcactttgggaggccaaggcgggcggatcacgaggtcaggagaccgagacaatcctggtaacacggtgaaaccccgtctttactaaaaatacaaaaaaattagccaggcgtggtggcgggcgcctgtagttccagctactcgggaggctgaggcaggagaatggcgtgaacccgggaggcggagcttgcagtgagctgggattgcgccaccgcactgcagcctgggtgacagagcgagactccgtctcaaaaaaaaaaaaaaaaaaaagaacttgcatatatggtatcttcagctaaacaaaattatatggtttttattaagcaccagaaaagcagagagcctgggtgaagttgtagccagctctgggcctgctttataattggatgatctaatcagtgaacactacaataaagtagaaaatatacccagaatatgaaaacttattaaataataagagtgtgcaaattctccttaattctgtccttcctattccatctttagaaaccatagtaaagttgtttaaagtatggaatctgtgtaaattttgtaaaatcatacaggaaaggaaagttgatttttgcctacatggacaacaccaggactgggatcatggaaaactaaattggcatgtactatctagaggcagaagtaatcaaacaattaattttgaataggagcatctcatttgtatcactctttcttaatacatgtggtttagaatttcagtaatcaaaccataatagcttaaaaataccaagttagctaccaaatctatgcgcagacgagattaggattcaataatgtgctgactagtctcattcactctaaacatattattttcagatttgacttaaatagctaagttactactttatcgctttgtccaaaccaatgccttccctctccttccttctacagtaccatcttttttcctgctcaatattatcaaaccaagctacaaatctaattaaactgtcttgatgccaaaatctctgctcctggagaaatgcatcatgcagcacatctaggtaagtgaattaaaaaagcatccaggcaggtatctggtgaatgtctcagttcatccttgcataataaactatcttctcctgctcattcatttgtcagtcacagtaactaaggattattatttgctgaatgtacgtgacaccagcaatttgcaaagtctgttggcaagaaaatcaggttagcatgacagagtgagaaattaagcagaagcctgatgtaattagctacaacaatcagtgctctaatttctgatttattgtttcctgttttcctgctgcactccactctgtgtatactgtatgtacttcatataggtcaaacaattgccttatcagtcctggcaaagcgagaggtcagagttaacaatatttatttaaacatgcaggatgcttccctctgcaattaggaaataactattactaataggtccttggcactatttcctcatttatacaatttttggggaaaaaagaaacagaagcaaggaagaattgggattcatttcttacatatgcacaaaagtttatttagttctccctcttggataattcttttactctcaaaagatctatgattctaaaagagccaaatgaatcattactgttacagatgaatatttataaaaatacagtaaaaatatctttcttgataaatagtggggttttgttttcaaagccctgttaaaaggttattgcagaacccccttggaaactctagtccatggagaattttcttgctgtccatcattcaaccacaaacagaaagtggtgttagctgttcttttcatatttttagaaagcattctttcaaattgcatataggttctattttgcagaactatgagctttcttacattcaaaatagaattttcttaaaacctctgaaataaagcaatgaacttctataagataaaaatacttcactcaaaataatgttaacatttctgaaagaatgaaaataacttaattcagggtaaattaaatgaaatttgcatcactggcatgtaaaagaataggttctaggtttctttaaaaacaaaggacctgaatataataagacaaatatttctgtttgtattcttttaattaaaaaattttatatgttaattctctcaagacactgtatacctttgagaagataaaatagaacatacttccaaggctttcagaaaatcctcagaatctagtcagactgaaaagcaagatgggacatagaagacacattagactgccaggaaatctggatttttctaaggtcatctctttcttaactaatagccttgggtaaatcatttgacctctttaagtctcattttcctcatagaccaacctgtactatgaaaggcatgcattcattagttctttcattattccacaaaattttaccgagtactaaacaggcactgttgcactgtgctaagtgttgagaaaacagtggtgaacagcagcaagtaagagaaatctttgttctcatgaagcctactctaacaactgcaagataaaagtagatatgcttcaggaccaatgataacagtgtgtcattaagtcagtgattataataatgtctttttcagttgctgatatccaccaaaatgatggaggggagaatgagcaaataaacaaataaatgatcataataggctgagagaagaaaaataaaacaagtgaaagtaacagagagttactggaggacaacttgaaaggggaggtcagggaaggattctccaaaaaggtaacatctgagttgagacttaagtgacaagaaagtgcccactgttcaaagatctgagaatagagcattaccaggagaaataggaaatagaagacttcaagtgggaataaataagttgtgactaagcaacagaaaggaatccagtgtaagctgctgtaatttccaagtgtggtagtggaaaagtatttaaatgaggtcagagaagtaggtacagttgttatcatacatttttaaaaccataagcaatttgaagtatattctaggttggatgggcagtaattgaagctaagtaggcttatactgtaatctaatttaatatgtaaaactaattcagcctctaggtagagaattgagagcaagagtggcagctatggcaactgattgggagtggatggcagtagtaatattggcttggactaggcagtgaagatggagagaagactaacataatgaaccttggagacagttggtaggacttgctcttgggttggatgtagaaaatgagaggaaatgagaaatcaaaatgactcctaggttttggacttgagcatctgggtggatagtgtttgcattaatgaggtagtgactactgattggggtagaataaatttggcttcagccatggtaagtttcagttatctattatatgcccaagtagcatataaaataggtagctggatattcaagtctaactagccagatcaggaccagagttattgatacagagatggtatttaaagccatgaggaattagatgaaattatccagaaaaacattataaatagagatgcagagaagtcctaagactaaactctaaagtaccttaacattaaaaggttcaaaaaagaaaaaggaatccacaaaggtgattgagaggaagaaactccacatgatttgatattatgggagccaagacaagaaagaatttcaagaaggaaggagtgatcagttttgccaaatattactgactggtagagaaaactgatgacagatgatggtaaaatagaagttaatgaccttgacaaaagtagtttcatgaactgtaaggttacacatctatggatttaaaaatcaggctcaggctgggtgtagtggttcatgcctacaatcccagcattttgagaggctgaggttagaagttcgagaccagcctggccaacatggttaaactccatctctactgaaaatacaagaattaaccaggtgtggtggtgcatgcctgtagtcccagctactcaggagactgaatcaggagaatctcttgaatccaggaggcagaggtagcagtgagctgatattgcatcactgcactccagcctaggagacagagcaagactccatctcaaaaaataaataaataaataaataataataaaagtaaaataaaaatcaggctctacaacttaatagcgaagcaggatatttccctgcccctttgcaggtgggaacttgagtacagggatgctggaactagctggctgctttggcactggcaggggcaaattccactcacttggatccactgcacttcacccttcatggggggcggggagtgtgcaggtgagtggatgcaggagctggggcgagtgcttttgagcactggcagaagcaaaactctgtgcggccccacagcagcatctggggaggtgcccatgacccctgaagccccagaaggagtgttaccgtgcccttttagctttactgtccatggacagcttaagtggtaacagctcagtggagggtcattgtgacaacattttgcacctgcactcatggcacccaagttcttgtccagtatccagaaggaatgagatcgcatgaacaaattgaagatggtaaacaagggggattttattgccattgaaagtagctctcagcagcaaggggagctgaaaaggggatggagccgtaaggtaatcttcccctgaagattccccgtggatggccagactcctctccaaagctacgctgtcaagctgtccctctgaagtaaagactcttctgtctgacgtcctaccatagtctctgacatccagctacttcccctccttctgctggctgagcctggggtttttatgggcacagaatgggggtggggtaggccatgggtggttttggaaaggcaacattcgagcaggaaaacagggatgtaagttctcactttgggctgcattgacaggcttttcagcttaagggtggggccctcaccagggacctgccctcttctgcccagaatttccctgcctcctgtccctatcaatagctatatgaccttgggcaagacatttaaatcttctgtgcctcaaatttttcttcttggcaatgggagtatagcacctacagtcagactggttgaatgattcaacacagtaatatattggaaagatcttgccatgattcaatagaccttctttctgttccccttttcccaactcaccagaaaatttaaaatatagttaactaaccaattctgttaaagtcaaataaagtccatacatcaaaatttgaaaaaatagatgctagaattctttaagctactcttttactcacaattttatgtaggacagcaaagcttaaactttgtaatggaaatggtcataagttactacgtagttatatgtagttatgtaatagccaataattccaataaattatctaaatttctatcacaaaggaaataactaaaacatattttttacccttagtactaaaatttattctgaaataaaggcacaatgaaagaagagatcatgacaatgggagtattctaacgcatattaatttttaaattaaatagtattaatgtctcagtaggaatgaatctatgcttttttgactgagagaacaatttcatgtataatctctgacaagataaataccctccttgcagtggaatctgttgttttacaattaattaaatgttttagctaggttaaatctcaatctctgcccaaattcttaaagcaatatgaatttctaccaagatattgaaacacctaaaacattttgtcatctggcaatttctgtagtatcttcttaatcgtatgtttagattaataacattttctaattttagtggagtctgatttgtcaatttttttcctgaagggttagcacattatttgtctaacgaacttttagaagttatttttttctcatctaagcatttattatttatttaacaatattacttcagtgccttctgggtcaaaaataggatataaaagttctctctctgcctgactcattgatgagagacatggatcttctgcccttggactgggacttacttcattgatgctcctggttctcatgccttcagactcagactggcatttatttaatacaacactggctttcctgggtctccagctttcaaacaggagatcatgggacttctcagcctccttaactgtattaaccaattcttataataaatttataaatatatatgtataaacatgcatatgtgtgtatacatatatctcctattagttctatttctttggagaactctgactaaagaatgtgagatagagattaaatgataactttatttcccatgttgatattcaattgatgtagtacagtttactgcaagtacaatcattcttcactgccctgcagtgtcaattttttataaattaattatccttatgtgtgtggtctgtttctgaactgtctattctgtgcctttggtatatttgtgtatgtctgcctaaattctacactgtctcaatcgtattaactttatattaacttacagaagagaaatgactcctcaaactttatttagcattttaagatcgtcttagacattcatggctctttgactttccatagaaacttttgtatttttcacagagacagggtctcactttgttgcccagacaggtctcaaactcctggcttcaagcgatcctcccacccctgcctcccaaagtgctgggattacaggtctgagccaccataccacagactagaaccttctttcagtagaaggctgttttatctacaatgaaaatttgttctttagttcagccaccttcatcaattaccttagttagatcttctggattacctgctacaacttctccatcagcacttgctgcttcaccttgcccttttaggttatggagacgtcttctttcgttaaacctcataaaccaacttcttctagcttccaacttttcttctgcagcctcctcacctttctcagccttcacagaattgaagagagttagggctttgctctggtataggatttggcttaagagaatattgtgactggattgatcttctatccagaccactcaatttcctccatatcagcaataaggctgttttgctttcatatcatttgtgtgttcacgggagtagcacttttaatttccttcaagaacttttcctttacatttatgattggctgactgtttggcctagctttcagcctatttcaagtttggacatgtcttcctcacaagcttaattatttgtagcttttaatttaaagtgaaagacatgtgactcttcctttcacatgaacacgcaaaagtcattgtagggttattaaatggcctaatttcaatatctttgtgtctcagggaagagaggcctgaggagagggagagagataggggaacagcctgtcagtggagcattcagagcacacacacttatggattaagttcgctgtattataggggtgtggtttgtggtactccaaaacagttataataaaaacatcaaagatcactgaccacagatcaccataacagatataatactactaacaataaagtttgaaatattgcaagaattaccaaaatgtgacacagaaacacaaagggagcacaagccagtggaaaaatggcaccaatagacttgctcaacacagcgttgccacaaaccttcaatttgtaaaaaacacaatatctgcaaagtgcaataaatcaaagcatcacaaaataaagtatgcttgtacttatatatcatatcttcattattattcagttttaaatatcttctaattgcaattatgttttgctgccccatatatttctgcaaaattacgttggggattatattgaagattttccagttaatctttttaaatttagtatttttatgatgaattttagcaaatgtttaaaatacatttgaaaagcataggcattctttggttactgtgtacagtggtctgtatctattgattatatcaagtaacttaattgtgtttataaccctataattttttcttgcctgttctatcagttattgagggatgtttgctaaaatcttcaaatatattgtggatattctgctgtccttttagttacatcaatttttgctttatgaattttcaggctatgtattaagtacatgcaaattcagaattcataagtcattctactgaatggaaaattttatcattccaaaatgtccttcttcagttctagtaatgtctcttgcccacaatcaactttgtcattcatttaaatatatcagatttcctttggttagtttgtactgtgtgtgactttccatccttttttttccttttttaaggcatgtatctattaagtattacatagttgaatttcttaaggagtctgacaattattgccttttaattagagtctttattatattgatatttaatataattcctgctgtattgggatttaaatcaatgccttgctttttatttatttttctgcatccaacgtgtctgacattccattttcctcctctcttactttctctatggttaattaaatattttgtctcatcttatttatcattctgtttcttcctggtaacattaatatttttagtcattagtcagagattacagcatgaatccttgacttattaaaatctaatataaattagcatttaccactttccagatattgctagaagctgaaaataatataactgcaattacctagcttacttgttgtacaattattcttatgtattttaaattgacatatatttcaaaccccctgttaaaagacaaacttcagctgaattaaatttaaaggagtttaattgagcaatgaatgatttgtgaatcaggcaggcccccagaatcacagtagattctcagagactcaagggatgcctcatggtcagaataaatttatagacaaaaataaaaatgatgtacggaaattagaggtgaggtacagaaacagctggattggttgcaggttggtgtttaccttatttgaacacagtttgaacactcagcagcttatggttgaaatatggctgataagactgaccaagactcagccactgttacaggcacatactccaaagttagggtttcaatcttgtctacctactaagttaggttgcagtttgtccacaagaactcaaatataaaagtacagagtccttctcaggccatatttagtttgctttaacactcctaaagcaatttatacaattaattttcatttctatatactcaaatatttaccctttattttgcttgtttttcttaatgcagctacatggttccatctggatcatttcacttctgcttaaagaaatcctcctgaatatttgctgctttggtagataatcaacaccttcagacaattactttaaatttttgtttagattttctagttattattggtaggacttttggtctgaaataagcttgtctgatattgctggaagcaaaagtctcacaaaatatctccctctcaaacctttctcccagattcatatattcaaatacctgctggacatctccacgtagatgtctaacagctcaaaccatattgaaaccctggtccttccctccccctccacaacaaaaatctcactccacccatatcacttccatcttacttgacgaaaatgccaaccttttagttgtttgaccccaaattttggagtcatcttttattcctgtcagaaactgttggctctatcttcaagacttgtccagaaatcaaccatttccctccatctgtactgttacaactctgatccgaatcactataatatcttttctggattgctacaataattccctgataggtctccctgagtctatatttgatccccacagaatgctcaacagtgcagctagaatgacacttttactggttaaatcacattatgccacttatcagcttataccacccaatgcctgcccatcagactagccaaagatcttactataacttgcaaggtcctcctggatcatcgcctccttgcctttgatttcatcttctaccattttcactgtgctccatcacactagcctctttctgtttttaaacataaaaggcattttcattcccacatctcaaagtcctcgctctagctgtttcttttgcatggaagtctcttcctcctcataatctactggcaaacctttaccctcttgagtcattgctgaaatcctaccttttcaacaacccctaccacgatcaatctatttagatctgcaactcaccccaacttctgcatggccctctcaatctcccttactctgctctacttttttttctattgaatttttcatcttctaaagtaaaatgtgcttatttttatggtttatttatatttgccttcaactactagaatatgtgtcccaagaagaaaggggtctttgtgtttttcatagatgtattccaaacatccacaacaatgtcgaatatataacaggctccccatatatatatctgttgaatgaagaagtgaatgaatgaataaatgccttcctctttctacacagtcctgcttagaaggtgaatgagacatttggttttcttgaacatggagaatatataccattccctagggtattaccgtttgtatctgctataagaaattaccacaaacttgatgacttaaaaaaacaaaaatttattatctcacagttctggaggcaagaaataatcagattgctgggccaaaatccgggtatccagagccacactacttccagaggtcctagaggagaatccatccattccttgaactcagaattcaagacgggaactcctaggcttgtgaccacatcactccagtcttcaagtacagcatcttcaaacttgttctgccttcagtgtgtttgtgtgtgtgtgtgtgtgtgtgtgtgtgtgtttataaaatctctctctgccttcatttataaggatataggttatggcatttaggggccacctgaataatccaacataaccttcccatctcaagatccttagtttaatcacacctgcaaagactcttttcccaaataaggtagcatttacagattctcaggacctgatatcttttgaggcctaagatctttttgaggacagcccaccacacctgggcacaatgtacagtgaatatagttcccttatgacttaatggagcaaagcagtcatgcaagccttggaaatccttactttgagatactaggttgaagagaaataaacatattttaagccactgttactctgggccttgttgagttcaatcataatgaatcctaactgataacagtgaataactgtgaatatttttaattgaaatattacatttaccgaaatggagttgcacaaactctaatgttatgtttctttgctttggactggaattttattgcctaattgggtaaccctggttatttcatgttgaaatactctctgatacacagtggaaataaaatgtataactttaaaataaagtttggtagatagtttaaaaacttgaagtgcctagagaatacaaaaattaatatttaaaaatctgattgtggaactgtttagaaccactgctctacatgaaagcacattaaatgactgaacagttatcctctttacctactacattttctcctaaagcctggtaaggagcaaattgcaacagcctagactgagtcacaaagacatggatgttcacaagaaaacatgtgctaaacaaataccatatttggtaagtacaagtggttagcaactgaaaagccttgctttgtaaatagaaaattccctctttaacctaatggtaaaagctggcatttattctgacatgtttgtccaacagtaaattaacaaaagagtggcacttctaattctacaaaattaatccccaacaagcttccctggatatcttcgaggatcagatactattggagataacaaacttaaaaggtgttagaagattggaactgtgaaagacagcctcagcaacctgtggaattccaatgaacatttgtgtttggtcattgccatgtatgttctattattaagtaactgttgggtaacatgtctcaggccaaaataaacagtattacctgatagatgtatgcactaaacattaatatattataatgaacagagctacattgctgcccaaatgatcatatacagatcatacaacagtgtaatctgtttatcacgataccaaatatcttacgttctggctttttctatagagtatcatcagttaacattcagaattaatgcgccccatccagccagctgcccaagccagagggttttttcccagtcaacccataaacacctagtggagaagtcttagctatttaatatctccatccatgtgtctccatccccattgttaccacttaggtcaactcttgaattcacatttctcattcaggttccattaagctcctaagcgagctccacacacccactgatgcctctttaatacattctccactctgcatccagaggcatcttctaatagtataaatatgtcattgttctgctgaaaaccgtttgatgatccactatattcttcaaggctattcataatctggcaatacagtggagccatcaagaacttgggccctaaagccagacagtctaggtacaaatcttggctctaacaccagatgtggttctgggaattcactttatgtccctgcttctcaatttttccttctgtaaaataattaatgtaatattagtgttgcattaatatggttgggattaaaagaggtaatgcttataaagcccttagtccagtgtctggcacacacatagtacacattccataaaaataatctgttatcatgtcttgagttctgtgttctctacagttaaaacaaactgctggcactctctgaagacattattctgcctctggatgctatctttacatgtgctgcttcctcaggcaggaaaccagtcttctcccatggccccaacaccactttctctagttgattcccacatttaacctttaaaaaatcatggagattgaatgtcctcctaaaagcctttcctcactttctgccatctaggtttaattcatatactcatggagtagtccatacataacactactctagggccttatagattatattgcaattgtctgcctaatggcctataaccccacgtgggttataagctctttggaggtcaacaatataactatttgtctctgtatcattagttcattttttgtttttttgagaaacagtctcactttgtctaggaggctggagtgtagtggtgatctcagctcactgcaacctctacttcctgggttcaagcaattctctgcctcagcctcccaagtagctgggcctacaggcatgcacaaccatgcctggctgatttttgtatcttttatagagatggggtttcaatgtgttggcaaggctggtctccaactcctggtttcaagttatccaccggcctctgcctcccaaagtgctgggattacgggcatgagccaccacgcccagcctcattagctcacttttgcactgctataaagaaatacctgaaactgggtaatttatgaagaaaagaggtttaattggctcatggttctgcaggctgtacaggaagcatggctggggaagcctcaggaaacttacaatcatggaggaaggtgaaggggaagcaggcatctcttcatataggcagtgcaggagcaacaaaggtggagggaggtgctacatacttttaaacaaccagatcttgaaataactcattcactatcaccagaacagcaccaaagaggaaacctgctcccatgagccaatcacctcccatcaagccccatctcccacattggggtttacaatttaacatgagatttgacagggacacagacccaaaccatatcacacagtgactgaagataagcaaaggagaagtagcaggaataaagattctgtagacttagatgaatctgagaaaaagaagactgtctaagggtctcaatcatcaagtgcatggtcatatgcgagtacttagaactgtatctttttctcaccagataaaatccaaactaattatattcaaatgtagaatatgaaaccatactagtacaagaagaaaacatgggctaactcctttatggcctgagaaaggggacaacattcacaattatgattcaaaatctagaatcagtaagggaaaagatggataaatgttaatataaatacatatagataaatacacccatatatacattcatacctgaaagttttgcatgacaaaaataaaagcacaagcaaagtaaaaaacaaatcataatacaattttgaaaatcttacttatacaataggcaaagatttattattcctaaggtgcttattttaaaatatgataagtaaagtgaaagaatagtgggtttttcctgcctggagtgtttttagatgaaataatatgatgtttgaaatttgttttgtgaaaaaaaaaagccctccctttcgacaaaagtaaggggataggtgaaataagtttgacaaaatgatagcattggaattatgcaattgattcatagatactcattctgctgttctgtctacttttgtgtgcaaacttgccataataaaaaagctttggaagtgcattggaagaaaattatgcaatcatctgaagggttaggctagttgaattccaacacttacttatcagtttcataaaatatatttcctaggaaaagcctttatcaatattataattttcacttgggattgaaatcactacatgctaagctctataaaaagctaagaaattttatcttgcatgttttgtttcaggaagggtcagcaacattcaaggacgtgctatctgaattagggattgagcttcctaaatctcagcttaagcttgaatgtgtcagaatggttcccagctgtcatgattgcactcaattaggctgaacttctggccatcatctaaaccaagaccttgctagacacctcacaggcccaggcccacacatttgagctgccttgaagccaaggcaggtccaggatattgatatataccatatacacatgactgttacacaactgtggcagatgcatccttaccatctcaccatctcctactgcttcccagtaaagtctactctgcacttcactgcaaaattatttttcaagaaggtctttatcgctatattccctttttggaaaacgatacatctttagctgtagattaaaattcacagtgtggtattcactgctctcaatccgggcaaattgagaagattctggtctcacctttgtggctataagcctccctcaaatgtttgctccctagtctatgttattctcactggcaacctgtacttaaagcgcatcctcttctgaacaggtgcttttctgcttattatacgatgctcgacatttgtaaaagtaaatgtcttatgtccccatccagatttttgagatttcttctcagtatttcctgaatccagcattaggataaggagtgggcactcaataacagcgattgattcttagagtcgaagctgtagaattttgtggtgaggaatatgattcttgcaggacaagtcaatgaaggtaccatcacaagctactatatggttctttaagtggcacaaaatgtgtgagagcatttagtgtgtcaaaggaacaagattatcaatcattgaacacatataacaatttctacttgtccactcatcactataattttcaagtgttcatttcatctcatatactatttccagacttcagagttattcctttagattcccctttcaactgactcatatccatcctttattccagttttcccattattctcaccccatagttaagtgcctcatcacttccttcctgaactggaatgcttactattaaaggaaatctcttcttcctctatgtcagtgatttcaacattcagcaagaagccaccattccccatgacaatcatcctgccataaaccacggttaactgatcagagtgtaacaactcctcaagttcagggaaaaaatcattttgagaattactgctccaatcaacttcctacaaaatttgtcctaaaattatcatcctaaaatagccctgtgatcaaactactccctactaatacaccttcaatggaatattgttctcatagaataaattgctaactccttacaatttcacattacctgacatatctacctgtaacctttgcaaatttcaaggtagctcatcccttatctacacagaacatttcaaacttacctccctcggggccttttctcagctgactccttatccaaaaagctgtgcattgcctgcgccacatcttagagtatcatgcttttacttatttttataattgtattctttctacctccaccttgacactaaacttcttagacagtagaaactacatcttaaaattatttttctccctcagcattcttaacacagtgttgtaatgtgtagtcaacaaattagatttatttttacagtacacatttatcaagctataattttcacaatgttttaattctgttctgaggtctacagatatctctacataaacactaaagccagtgatttaataagtgaaaggaatgcatacattgctttgcaaaaaaattagcctgatacatttatatctatatatttatagaatcattttcccaaggctcatgaaactaaagcgcacacatacaccatagacacacacacacatgcacacacacaccattatagtcaattcaaatggatttatattgtgtcaaattaaatgccatatgaaatttataatcagatacacaaaatatgaatggaatcatgaatacactgttgataatggataccatagctcacaaatatgatctccagttaagaagagagaaataattgtttcattggatttttggtatgcgctaatcaccatcacaaaaaaatcaatttaattacacagtattcagaaatttaacaaacatgcagatattaagttgaccacaataaaacctttaaatctgcaaaaagacatgaaaatatatggtcaataataccattgttcacttgagtcagcttaacattttactttattcagatgccaaagataaggtagttaaacaagataacctgttaggtttcttattctggatttctacactccatctcttagacgtctgagaccaggtattgaactgtagttcaaaggagcttattggtttgcaaatgtgttttaaatagatccactgttagatcactaagcacattgcatgactcattttcagaaaacttacattttcatacttatgtaattttcctgataaacctaaaaagttgtttttatttatgtattttttttgattgattgatttagagacgcaatctcactctgtcatccaggctgtagtgcagtggcatgatcatagctcactgcagtctcagactcctgagctcaagggatcctcccatttcaacttcccaaagtgcttggattacaggtgtaaactaccgcacccagcctatttattttataaataaacaactctaacaattatttgttagatcacaagtttacggtggcacagagcctccgggaatttatgggtatgtgaaagaaaatttctatgtgaagtggcaattgcttacttcccttgtaacatcagatgagaccttttctaggaaggtataataaaatttgggaagccaggattcgcttcaaattggcaagccccaagcaattttttcttaaaactttgaaaagtttctaataatgatgattattccttaaaaatcaagattatgaaaaaagtacgtttaggatgctaataattcaagcgtatatctgaatttatctgtccatccatccatctaacctctctttctctctctctcactctctaaggctcactataggaaaatataacattatgaataaaaagtgttgctcacttttgaactgcaaagcaaaatttagtaaaagtatacgctgatgcttatcatctaagcatgatccgttacttcatgggagtttggttttcttaaacgttaaaaaaaaagattatcctagtcatagctacaattgctgagataaatcaaagacaccatttcacttcttcgtattatcaaaatccacatgttgttgccaaaatagacacgtgctcatttttccaggggtctttttaggagggaagtccctgcaagacgttatcactaatttgctgccagtaaatgtgtggtacaaaccagaatttcagtttgacccttgattttataatttaataccaatattacttacattattagttttactggtaaatcaggagtaagttgttggagtccagctgtgaccccagggcaagaactttttgcctgctgtcaccttctgacagtttaggctgttaattacctccatcaactagaacacaagcacctctctgtctgccagctggcaggctgagcttcagaaattggcagcttgggaagatctaaaaagctgtaaagggggctgctatgtaaacagtttattgtacaatatttgatgaccacagtaggcccgcatcagtaatcaaaggtaggctccgctattgggcattgatcggttagcaaagaagaaagtttaaaatagcttttgtttctatgttttttatccggcagagtgaaactaagggtttagttctggaggcattatgttggtggccgtgggaggaagtcagtcaatcatttagttctgctgagataagcttggacccagtcgaaagaaaggtaagtcagcggttgtgtgtgcgccttgaaagtttaaagctcactgctggttaaggatactctatgcacattccctataaaaaggaacttgttaccataggcatgtgtgtaaattatgtatgcactgtatggaataactaattatgtttgcaactatattctgatcaaaatgcctttcctaacatatcaatgattttgttttgttttgtgacggagtctcactctgtcacccaggctggagtgcagtggtgcaacctcagctcactgcagcctccgcctactgagttcaagtgattctcctgcctcagcctcccaagtagctgatattacaggcgcccaccactgcacccagctgatttttgtatttttagtaaacacagggtttcaacatgttggccaggttggtcaatgatgtttaagacacattttccaaagccatgctcaaattttgagattgtatctgatatttcacagtctcctttccaaactccacagaaacatttataaatgttaatttgataagactatcaaataaataaaaatgttaaaaacaatactgacttaatctttaattctataattctatttgaacattaaaattctgtcatctggtctttgttgattaaatggctaatttcataagccacgtgggcttaagtttaaatcacaatcaaaatccaagttacttatttgttttaaagaaataaaaacaagcataatacactgtgataaaacaacattcagtaattttcagcaaagaaatgaaaccaagttagcatgcatttgcctttgattcatttctttgaagcatttcttcatcagtctttccagagaaaaaagtagccttcctgacattttctttggagcctctttttatagaaattatcagacctgtttagaattaaccatttttattcaggtgcatgcatgagtgcgtacacacacacacacacacacacacacacacacacacacacacgccccatccaaacattctacaggtataaagatgactctactgcaaaaagacttgaaaactctacatctgcgtaagaggaattcctacaggcctgcaatctttgcctttgcctccagagaagatctcagatccgcatgcccctcattctttttaaccttcccaaaggatctgtcactaatattggtaatagtagctaatacagattgcttactgtatgccatacaatatgagaagcactttaagggcatcatttctcatttatttttggccactgtcttatgagatagattataaaattgccctcactctacagataaaggccagataacttgctcaaagccacgcagcctacaaatgtgaaagcagagattcaacaggaagtctttctaactcctggctccagactctaaatcactccactacaccacctcccaagttactttcttgaaagacaatcccatttctgtgctttcctggctctccttctttctgccaaaacttcatcaactttctattattgtctctacgtacatgaaagacttttcccattccatgcgcttcttcaaattcactgttctcatttatttcagtagttttgaattttactactatgggtgtggttctaaaatcttcatcacttttcttgagtctctgaaagctctgtttggctgtggttgtgcttagccaaccaggctatgaccggtctgtccaacatggtgaaacccgtctctactaaaaatacaaaaattagccaggcgtggtgttgcatgcctgtagtcccagctactcaggatgctgaggcaggagaattgcttgaacccagcgagccactgcactccagcctgggtgacagagcgagactctgtcctctctggcaaacctgcccttccacttgtaattgcatcttagttgatggtgcaccatccactcagaatttaggattatctttcatcttttcattcaccactcattcaggtgaaaaaagtctcatgaattccactttgaagaaatctttttttcctgtacttatcgtatggcctattttgtgtccccattgttactcaccaaagtaataatgcagcagcctcctaactgcttgcatagcctcttgtctctgtcctcactaatcagtcccacattgtatcaccagaagcatccttttaaacacagaaccagttcttaaactctcctcctcaaaaaccttcagtggcttcccaatgtaaacagatgtccagtatcagtaaacccctggacttagttctggcttatcttagcgcagattaacttctacttcaatactccaagaggcatgtgcagccattccctaatcgcgccctccccttgcctctcctatgtttgtgctatcccttctttgtgggctttttctccttctctcatcttaatccctcacaatccacctcgaatttcctcccatgaaactcctgatggccctactaaaaatttatccttttcttcatttacttaacaactatttattgaatatttactaagctttagaatctcaaaaataaaagacaggctcccttcccaagaacagtctataacattctaatggggaagacaagtaaataagcaattaaaattacatatggttttcatgaaacacacaaactaccaatgctctctcaagaaaaataaaattagtattttattaatatattatattatttagttttaaaaattttgttttgctataattttgtttaaaaaaaaaagattgttggctgggcgcagtgactcacgcctgtaatcccaacactttgggaggccaaggcgggtggatcacctgaggtcaggagttcaagaccagcctggccaacatggtgaaaccccgactctactaaaaatagaaaaattaactaggcatggtggcacatgcctgtaatcccagctactctggaggctgaggcaggagaatcacttgaacccaggaggtggaggttgcagtgagctgagattgtgccattgcactccagcctgggtgacaaaagtgaaactccgtttcaaaaaaaagaaagaaagaaagaaaaaagaaaaaagaaagatttattcactagtgagctcttctcaacatttaaggaacaagtgataccaattttatacaaactcttctaaaaattgaagagttcactagtacactgatattaaaaccaggcaaagaccttatggaaaagaaaactgggccagatgttttggcacatgcctgggctgcttgaggccagaagtttgaaacctgcctaggcaacatagcaaaaccctgtctttacaaaaaataaataaataaaaaataaagtaattaaaagttagctgggcatggtggtatatgcctatagtcctagctacataagagactgaggcgggaggattacttgagcagtctttaattgcttcagtttgaggcagcagtgagctatgatcatgctactgcactccagcctgggcgatagagcaagaagactctgtttcagaaaacaaaacaaaagaaaaaagaaaactaaagatcactatctctcattagtatagatgcaaaatcctacacagtattttagcaaattaattcaagcaatatatttaaaaggataatgcttcataatgaagtagatttcatcccagaaatatgagatttgtttcaatatttaaaaatccataaatgtaacagtttctcaaattttgcttgtttcgatgacctaggcagttttgagaattaccagttgggtattttttagaatgttctttaattggaatacatatgaaaatttttaaataattagtctggaattatgggaataggaagaagaacacagaggtaaagtgcctttttttaatcacatcatttcaagtggacatgacataaacgtcactatcactgttgatgttgacctgggtcacttggccaaggtagcaattgtcaggtttctttactgtacagttattctttttccctcttttcatattgtactcttttgaaagaaatgagtatgttcatgtccgacttaaagagcatagagttatgctcttcctcattgaggaagtagtatctacataaattctttcaaatttttctgcacaaaaatttgactcttcttcctcatttaattatttttttattttacttatgctttaagttctgggatacatgtgtagaacgtgcaggtttgttacatagctatacatgtgccatggtggtttgctgcacccatcaacccataatctacattaggtatttctcctaatgctatcccttccctagcccccgaccctctgacaggccctggtgtgtgatgttccctcccggtattcatgtgttctcattgttcaactcccacttatgagtgagaacatgtggtgtttggcattctgttcctgtattagtttgcagagaatgatggtttccagcttcatccatatccctgcaaaggacatgaactcatccttttttatggctacatagtatttcacggtgtatatgtgccacattttctttatccagccgatcattgatgggcatttgcattggttccaagtctttgctattgtgaacagtgctgcaatcaacatacaggtggatgtgtctctatagtagaatgatttataatcctttgggtatatagccagtaatgggattgctcggtcaaatggcatttctggttctagatccttgaggaatctccacacagtcttccacaattgctgaactaatttacactcctaccaacagtgtaaaagcattcctatctctccacatcctctccagcatctgttgtttcctgactttttaaagatcgccattctaactggcgtgagatggtatctcattgtggttttgatttgcatttctctaatgcccagtgatgatgagctttttttcatgtttgttggccacataaatgtcttcttttgagaagtgtcttttcatatccttcacccacttcttgatggggttgtttgttttttttcttgtaaatttgtttaagttatttgtagattctggatattagccctttgtcaggtggatagattgcaaaaattttctcccattctgtaggttgcctgttcactctgatgatagtttcttttgctgttcagaagctctttagtttaattagctcccatttgtcaattttggcttttgttgctttagtcatttgcccatgtctgtgtcctcaatggtattgcctaggtattcttctagggtttctatggttttaggtcttacgtttaagtctttaatccatcttgagttaatttttgtataaggtgtaaggaaggagcccagcttcagttttctgcatgtggctagccagttttcccaagatcatttattaaatacagaatttcttccccattatttgtttttgtcagatttgttgaagatcagatggttgtagatgggtgacgtttttctgaggcctctgttctattccattggtctatatatctgttttggcaccagtaccatgctgttttggttactgtagccttgtagtatagtttgaagtcagttagcatgatgcctccatctttgttctttttgcttaagattttcttggctatatgggctcttttttggttccatatgaaatttaaagtagttttttctaattctgtgaagaaagagctatgatgactaaatgtaatgccttaggatgggtgggattctgaaacagaaaaagatgttggatagaaaccaagaaaatccaaataaaatatggagtttagttaataataatttgtcagcattgtttccttaattgtaacaaatataccataccaatgtaagatgctaaaagggaaaccaggtgtggggtacacaagaattatctataatatgtttacaatttttccgtaaatctaaagctgttctagagttttaagtttatttgttttttaaatgcctcagtttggaggcaccatataccgatccttgaaaggatgtggtcaggtctctcagaaagagtgaagaggccaggcgcagtggctcacgcctgtaatcccagcactttgggagggcaaggcaggtggatcaggaggtcaggagattgagacaatgctggctaacatgttgaaaccctgtctgtactaaaaatacaaaaaattagacgggtgtggtggtgggcgcctgtagttccagctactggggaggctgaggcgggagaatggtgtgaacccaggaggcagagcttgcagtgagctgagatcaggccactgcactccagcctggatgacaaagcgagactccgtttcaaaaaaaaaaaaaagagagaagaaagtgactggataattgacctggtatttacattattgggaagcactgaccctatctaatgttggatttctgggcttctggtgtgctcttttcctttttctctcctgttctcaatcaatattgtagcccactctccccagaaaagagcttttggtgacttggaaatgaatgagtttcattccccctgcctgaattatagatttaactgtaaaagagataccatctaattttattaccgataccactaaagcataaccctagtttggggagagatctgatctttatgcggtttgcggagtagaatgtaaccaccaatttgtttctggtattgctaaatgaactagacttatacttttgttgttgttatactacttataattgctcttttgttactttaaaaattcaaatagttgtaatttcatctggtttgaccaaataataatgtcaagaataaaagggaataaacatttatttgagcattgaaaaagaatccataagtgtaattcatcatatcaataaattaaatttgactacaaaagaaaagccatatgatcatctcaatagatgtagagaaaccatttgacaaaattcaatgtcattagtgcatggtagaaactcccaggaaagtataaataaaagggaactttctcaacttggtaaagggcatctacagaaactgtacagttaatcttattactaatggtatgtgatagtgaaagctttctccctagatattagaatcaagaaaagatgtctgtttccaatacttttattcaacattattctggggatcttagtcagtacaataagctttgagaaaaaagaaataaaatacaaacaaattggaaaaaaagaaataaaagagtacttgattatagatgacatgacagtcttggtagaaaatcctaaaggatcaaaaaaaccgtggccaggcatggtggctcacgcctgtaattccaacactttgggaggccgaggcaggcagatcacttgaggtcaggagttcgagaccagcctgaccaacatcgtgattcccctgtctctactaaaaatacaaaaattagccgggcatggtgttgcgtgcctgcagtcccagctactctgaaggctgtggcaggagaatagcctgaacccaggaggcagaggttgcagtgaatgaagattgtgccactgcactccagcctaagcaaaacagtgagactctgtcaaaaacaaaaatgtctagaaataataagcgaccatagcaaagtcacaggatataaagtcagcatccaaaatatattgtagctgggcgcagtggctcatgcctgtaatcccaagactttgggaggcaatgatgggaggatcacttgaggcaaggagtttaaaaccagcctggtcaacatagcaagaccccgtttctacaaaagaaaaaattttttaaaatgttagctaggtttggtggcatatacctgtagtcccagctgctgggaaggctgaggaaagagattagcttgagtcccggagttcgaggctgcagtgagtcatgattacgccaccacacttcacctgcgtgacagagcaaaacccctaaaccctgtctcaaaagaaattttatatatatatatatatatatatatatatatatatatgacattaaaaagatcaaattgtaaactgcctctgagaaattcacctgaccagtaaaatatatatgtaaaatatatataaatagataacatataaaaatatatatggaatatataaatatatagataatatataaataaatatacatatatacgatatataaatatatgacatacatataatataaaaagtatatttatatattatatattctatatataatttttatttgaaatttcacgatatatactgttttcatgtattagaatgtaacaattagaaattttcaataaaaataacagcatcaaaagctaaatatttaaggatcaatttaactaaatcagtgaaaaatcctggaaatttcaaaacattgtttaaaaaaattaaagaacacctaaacaaatggagacatatactatgttcatgtattggaaggtccaatattgtaaagaaatcaattcttcacaagttataaattcagcataatctcaatcaaaatcccaacaagcttttgttgtagaaattgacaagctgactcaaaaatatatatgaacatgtaaagtacccagaaaagacaaaacaatttttatctaattttttagattgacaaatagttattgtacatattcttaggatatataatgaggtgttgataaatagacagtgatcagatcagcataattagcatatccatcatctcaaatttttatcatttctttgtattaggaacattcaatatcctccttctagctatttaaactacatgatatattattgttaactatagtcatcctacagtggtagagaacacaagaacttcctttcatccagtttaacttttatattctttaacaaatcccttcctatccttcccttcccccaagttttcccagcatcaggtatcctctgttctattttacttctatgagttcaacgttttcttaccttccaaatatgaatgagaacatgtagtgtttaactttctgttcatggtttatttcacttaacataatatcctccaattctatttatattttcacaaatgatagcatttcatttgtgaggaggcaaaacgtaagaaattactcaataggcagccagcctggggtcatgtctgccctggggtcatgtcagcctgggctgttactcagatgtaggatgtgggcttttggctgtatggccagcctgggatcatacctgccaagagtggcctgtgaaactgtttctcaggtcatgatgcttcttaggtctgaaacacaattgcaaggatgcttggttggctcaggggtgtcctcaccaacagcagcccaaaaaactgtttctcaggcccggaatgtgggtacatggctgcttggccagcctggggcatgtccacctggattggcccacagggctgatactcaggtctgggataggtgtttttggctatttggtcagcttagtatcatacctgccaagagtggcctgaggaattgtttctcaggccctgaatggggatacagggccactggggcaggccagggctctctctggagggtgcaggtgtgctgtgggactgtttctcagttcctgggtgcaagcacatagccacttcactggccctggagcatatcagctgctcacaggcttgggggcctctcctgctttggggagggtatgcagcagtttggccagctcaagggcaggttcaccctgaacagaacaggaccagagccacagcccatccttggcccatgctttacgaatctgggattgaggtgttcagcttcccatatgggcttggtggaatgaagatggagcccaagtgctggagaggtgaagtggctactggccctcagagcagggcacactgcagaagtagctctggtctcagtatggtgccatgctatagcaccatggctcacaggggatgaatagagggttgggggtccacaccttgttctcctaatctaggacaatgcagctgtgtgaattcccagcaagactccaaacctgtctcaggacttgtgaggactgctggattcacctgctataaggattgtaggtgtttgtgatggcagtgggcactggtggagatcttctgcttacctttatccttgcagcaggaagtccttcctgactccagcagatctcacccagatgaagaagacaggcttcagaggccaggtgcctccagctgccctcctgtacttccagccaccacagctgcatctccatccccgcactgcactccagtgctctccctttcatactctagtaaaatcttagctgtttatttgttgcctgagtcctttcctgtggaggaggggatgaacaccaggtgtctgtattcagccatcctgctgacatcactcccaatacaattttttgaagaacaacaatgttagatggcttataagccatgactttaagaattaccataaagcaggtgctgggataactgcctatctatatgcagaagaatgaaactggacccttatctatcactatgtacaaaaattaattcaacatggattaaaaacttaaatgtaagaccaaaaactataaaaatccttgaagaaaacctagtaggtactcttctggaaagcctcagcaaagaatttatgactaagtcctcaaaagcaattgcaacaaaaacaaaaattgacaagcgggaactaattaaactatatagtttctgcatagcaaagaaactatcaagagagtaaagagagaatctatagaatgggaaaaaatactcacaaactatgcatctgacaaaggtccaatatctagtatctatgaggaacttaaacaattcggccaggtgcggtggctcacgcctgtaatcccggcacttcgggaggccaagacaggcaggcagatcacctgaggtcaggagtttaagaccagcctggccaacatggcaaaactccgtctctactaaatacaaaaattagccagacgtggtggtgggcccctgtaatcccagctacttgggaggctgaggcaggagaattacttgaacctgggaggtagaggttgcagtgagccaagattgcgccactgcactccagcctgggtgacagagtgagactccgtctcaaaaaaaaaaagaaaaaagaaaaaaaattcaacaagcaaaaacaaagaacccattaaaaagtgggcaaaggatatgaacagacatttctcaaaagaagacttacatgcagccaacaatcatatgaaaaaacgctcaacctcactaatcattagagaagtacaaatcaaagccacagtgagataccatctcacatcagtcagaatggctattattaagaagtaaaaaaaaatatgctggcaagtctgcagagaaaagagaatgcttatacactgttgggaatctaaattacttctgccgctatagaaagcagtttggagatttctcaaagaactaaaaatagaactacctttttacccagcaatcccattactgggtatatagccaaaagaaaacaaatcattcagccaaaagacacatgcactcatatgttcatcacagcagtattcacaatagcgaaaacatgaaattaacctaggtatccatcaatagtggatcaaatagagaaaatatggtacatatacatcatggaatcattttaaaagaacaaaattatgtttttcacagcaacatggatgcagctagaggccattatcctaagtgaattaatatagaaacagaaaaccaaataccccatgttctcatgaataagtgggagctaaacgttaggtacacatggacataaggatgggaacaatagacactggaagctactgaaggggggaaagtaggatggggacctattgggtactatgctcactacatgcgtgacagaataatcccaccccaaacttgcctcacacaatatacccgtataacaaatctgcccatatacaccctgaatctaaaataaaagttgaaatgtaataaataaaagacgaattaccgtaaaagcagggacttagcaaaggacagaaataaaataagcttaaggtaattcaatggtgaattaatagtattttcaacaaatcataatagaacaagtagatatgcatattaaaaaataagcttcaagctttgcttcacaccagatataaaaatgaactcaaaatggattattgacccaaatgtcaaagataaatctactaaatttccaaaagaaaacataggaaaaaaaattatgaccttaggctaggtaaaaaactttttagaggagataacaaaaatgcacaaaccataaaagaataagtttatcagatggacatagtcaaaatcaaaaacagccaatctttgagagacagtataaggaaatgaaaagacaagccacagattaagagaaaatatttgcacaatacataactgatgatcttccagtatcatagactcattaactcatgagttattcattcaaacagcatttcagcctaactgacttttcttaggagataagtgtaatcaagtacaaaatttacagtgagaactgttttgtattgaagcaattatatctttttctaaaacacattcagatgtgaaatgaagcaattatttcttaatccaaaacttccaaagcaagtaattcctctgtggttaaatggtctgtattaaatctggttatgtaagccaataacccaatattttaacgcaatagaagtttgtttcttactgttgtcacagtcaattgcagtttgagagggtctagggatgattctgccctatgctgtcatttgaagatttcatcttcttgcttcctgtggttttgctacctttatagggcctcgtgttattgcactggacctagctggaagactggcagagatagagtgtggcaatcacaagatcgatttgaagtgcaaggtctgaaagtggggtacatcacttctgcctgcattctattgccagaactcaatgctatggccacacccataggcagggaaatgtagttaagccatgtgcacaggaagaaaaggaagcaagtgagcatatacaattgcctctactacagtaaccatgagaagaacacatacttaaccattttcctttagtaccacatatattttagttgcctaaaattttttggagcaaagtggattataaatcaatcacttacactttccttgtcattaaattatttttatttatttatttattttttgagacagggtcttggctctgttgcccaggctggagtgcggtggtgtgatttcagcttactacaacctccgcctcctgggttcaagtgattctcctgcctcagccacccaagtagagggggctaccggcacgtgacaccatgtctggctaatttttgtatttttggtagaaatggggttttgccatgttgaccaggctggccttgaatttctgagcacaggtgatacccccgcttcagcccctcaaagtgctgggattacaggagtgagccaccactcccaaccatcttgtcattaaattataaccagttcaataacagggatgttctgtacatgaaaactttccatagtactttattatatttaccattatggaaggagatcattaaatttttgctatgatcatcaaaaaatgctataaaaatgacatctaatgaaattcgaaagtttccacatttgcacccatgtgtgtaaatatgactgactgcacataaatatctgaatccatgtttccagataagctcaaaaaaataggtatagttcattatttattttctttatttcttcttcttatctaggacaaaagtgcatattgactacctcattatatcatcatgtgatagaaagagaagtagggatcccaggctctagctctggctcccaatacctgtggccttgacaaaccaggtcatgtctctggaattcaccagtaaagtaaaaagtgcgtgccagatgatctccaaggtactttctgtttctggtattctgagagtctttatggggccatcaactcaagctagctggctcccatttgggtcaaagtgtcttatctttcaagaagtgaatattttggtgtcagaaagtcaactgaaatgaaaagagagggagtaagggaggcaaggcgggagagaaagaaactaaagtgaaccaaaattcttctttaccctaggaatttgtagaaatttgtacaattaactctacccagggaaaattagttatttcttttctccccacaagacattatttgggccaccctatgcagcataatgaggccctgcctctacaaaaaaattaaaataaataaaaaattagccgggcatagtggcacgtgcctgtagtcccagcaactggggagactgcggtgggaggatcacttgagcctaggaggtcgagtctgcagtgagccataatcacgtcactgcactccattctgggggacagaggctgactctgttttttaaaaaagagatatttggggctcagaaagtcagtaaacattgccacagattataacctaatctaccctgcacctattgattgtgggacaagatgtaacatttcaatggctaagataatcaaataaatattaaaaatattaaaatttcctaatcacctctaattcatttataaggactaaccacagataagatgatttaggtttcaaaagaagccacatgaagtagtgaaaagagcacagaaatgtaagcttgaaaatctatattctattctgttctctgttctgacccatttgtaggatactggcaagtgacttaagatctttaaatcccagttcattaattgaagaataaaatgtttggatttgttggtatttaagatgtctggcaacaatggaatttcttgactctatgaaagatgagacttattgagaaatagaggtaactttataacactgaaagcctatcctagttagatgcagtaggaaggctcatgagcaacgttttcttagaaaccagaattcttgcttattttggatttaccaccactgttataaggagcaaaagaaaaacttttccatcctggttagaagataaaaggatgagttaagatcatatgtcacagatctcaagccagcaaagtttataggtagaataatttaaaaataagcaagtatgtaatctacatcaatgaaaacatgggaaacttgtttttttttatcattaattagagcaacaaaactgggcagtgggggtgggggcaaaggcttcttaagagaaattaatctcagtttcatgcctcaacttgaaatgtaccaaactttcaggtaatagatttatttcatagaaagcaaaaagagaatatgtattgaaaaaattattccaaataaaatgaaaataatttccagcaaagattaatattgctcttagaacttaaggtacaggaatttttttaaaaaaagagatttcatattcagaaatattctcatagcaggaactttttctagcgtaatattagaaaatttcctgaatattatagtagtgagaaacttcattttaatttaaatctattttgctgttagatttcacacaccaaacatcctattagtctaggtggttcaattgcataataacagtattttttatcgctttagatgatctctttagatctgctggataattttatcaatgagagaaaatgaagactgttatttgattactcgagtcttgagacaatcataagtatttagattcataaagccaaataaacaaaaggggggtttgttgctggccatatgatgagcacctagcttctctgtcgttaaaagtttcctcacaccttacgatgtaacaaaacatttcacaaatagccagaaagaaaatcagattcttgtgaggcttctcaagatagttattgtgaatgtttgtgcataaacattctgagacagacaggggtgcgcaccctcctgcaccccaccgccacacacaacctatctcagaaatttgcgaaaacatagtctaacagtttctgtggaaaatgcctcattaatcttgggtgaatcaccataggaacctgtggaaggtgaaatcttgaacaggatggagccttctcatcagtcattgattagtgttagaaataactcctactgtttcatgttacctacaatcttcaaagtaataatggttttcagtacagaaataagttagaaatatttcgaagataatgactcagatgttattttagaattccccattacactaaatatctaaaacaataaaatgtttacagttatactttgttctctgcccgattttttctaactttccacgaattctcctgtatctctggattatctatgcctctgttctcaattaaaatctccaaagaatggaaagactgaaatacaagaaaaagagacagaagctacaagagaagagagaagaaataaaaaagaaagacaggaacttcacgttcttaaaataaaaggtaaaacttcccttctagactctattgctcaagattttcagcattgaccgcgataacaaaaacttctaaggcttttcaaagtaagtctttcgaaaaatttcacttatttttttaactcactaactatatccagagggaaacaaaattcaactgaaatatgaaactctcttggatgtcatagacagcccatactacatgttttccaaaagggaggaagttttccaaaaatttgtagaatgaggtaggtgtttgttcattctgggcaaatcatccattaacactcagaagacttttaagtatgccatgagagattctacccatagtctctatagcacttgtatttcttcagctaattatatgaacacattaattaacagtggcaaggacaagcctcagccctctaaaggcaggcagtgactttacaattcacagagaataaattggaatcaaaataaggcttggcttctgtcaatggtgtgctggtgcgtgtgccaggcttaacgccaggctttccaaaagggaaataaataaatatgtatatatgtatatattatatatatatatatatatataatatacctgtgtttattatttcttataaattttactaatatacacaatgtatagtatacaaattataagtaataatgaaatacctaaaactattttacattttatatagccaatttattctcacagaaggcttttgtttatttttgccagattcttaaatccataatcaatctttttacaattaatgaatgcggtatcaacgtgaatgttggctaatattccatttaccttaacaagcaaggtgaaagtaaacacgtcaaagtatgttggaactttattcatgtatcagggatgtgttcctttgctgaatcagataatagtttgcaaaaacagtactggaaggatatgtcatcaaattgtgtgctattcacaaggtagcagctacagctacaacatccacatccttttaggtttgatctgtgttcttaacatttcttccatagcttcctcaagtctagactaccaaaaataaataaataaatattaaaggcttgattcttagtgtttgctgatttccatggtttaagtactcccacaatgacagaatttaagctaccaaaatccctgaacacggagtttggaagagatatgcaatagcacagcattatatagtatttccaccagacggacacaataattataaataatctcaagagcacagataatattatgatgtaagttaattagaaactagtgaattttgattattacctttccttttggtataatttatttaattgtaagtttaaccactccaattttcattattggctgtctttaacaaccagatcacaaaatacctgactatttaataatctgttcttgtgagccagtgtgaaccagctacggcacttcactgcctcttgttcaaagtttactgggaacttgagtactgaacattttgttacagcttcatgaatctaaattcctgtccaggtaaaagattactggagttaccagaaaagaattttgtttaacttcatctaagactaagactataccacttaataagtcctaaatttgacaaatgcttttgaaacttaatttgttaacattatgaacttcttacctcaatgtgtatttacacatcactgaagaacaataaagggtagtttacatgggttgacatgctacataggcttaagggctttctgtttctttgtttccaaaacagattacagtgatcagaatagaggtagcaggcaaatagtctgcttattctcgctgaagccattcagagcaaaatttatttatactataaaatgccaaggcctataaaattcccaaagccccatctttaagaatgtaagcaacagatacttggatgtacagaccagagtttggccagaattccattaagtgatcttgagtcctatcaaaaagctaagctaaaagatacattaaaataagtaatatatttagttgtgaataaaactgtgcctctaaaaagtgaagagacagtgacaaagcagaaggaccaagagggccaggaaggtggcctcaaagagggtctgaatcgaaattccagtcaagcggctacactaaccatgtaactttgggaagttattcaatcagtctaatcttcaatttcctcaaagataaattagagatggcagtactatcaggattatatgagagactatttgaacatcacctggcacatagtagcagatcagtaagtgacagtatcatgaaaacatactcccttctgcctaaccagaaaggcgaagactcaggtgggaacctcattgcgaatacgtgtgagtaattactcaagattctttctcttggaagattttattcaaaggtgaagtaagcaaatactagcattagctccaaggctacctcagcccccaaatatctacaacacacagttggagtttgtcctttgagttaaggcaatgcacatgaaatatgggactctgaagctatacagtatttgatcaccatcaaatacaagatatttggaagtactgctaaacctctgcagtctgttacaaaacaataataaagcagaggtgttaaatatctgctatctgctattgaaagaaatacaaaccattcaaaaggcacaatttagatatgatgagattagaaaattccattttagatgcatattttacctgaaattgatttccttagccctcagtagccactaatttattaatctgtattagtttttccatttcatttttctgagagaaggtggagcaaagaacaggtaactgatttaggtgaggatgggaaactcctaccacctgggagggcagtcttcacggcatgaggcagtgatgggcttgggctgaccgcagctactggggagcaatggggggcaagacaagggaagagctgctccaaacaaaatgatttcattttctagtttttttgtgaaaacacttctgtccacagtcataaaatcactttctttgagatacacaatattttcttggctattctcattaatatagcaatattataacaattttgtaaattttaaagaaattactgggacctttaactgcaaaagtcatcttgtgaggtaatgaacaaaaaagaaatgcttcaactgaattaatagtacttcttcatgcttgtaggactctagaaaaagtgtatgagctagaattttggaaatagcacgtaacagaaacaacagccaagtgggaaattaaagtccaaaagcaaaagcagtggcagttccagaatgtttccaaaggagaggcataggggtcatcttttaggtggaaagaaaactagggaattttccttgatacagtatttgcagagtttttgcttacaggatatatttatttagagtaacttggtaccaggagttggagggggccctgacggagattatgagtgaaataaagtccctacaagacaaaaaaaaaaaaaagtctcacatttctttgcccatatacctggaattgctaaaatgagaagggaaaaaaatctaaaattatatccttagctgaaaaactttacccaatatttttctgcttataagaaactaagtttaatcaataatcaacattgattgcctacaatatgtttggcatagaaattggtactgggtaggaacaaaatatgttctctgccctcttgttgcttaaatcaggagagaagacggacatcaggcaagaaagtggtgtgattggtttcagaggaggaggaaggatgagtggagattcaacctggtctagagggtcggcgaggtctccctgaggaagtggcattccaaaaggggttgcctaggcaaaagctgtgagttaaggggtgagagagctgaaaggagaacaggaacagaaaacatttctagcagaaggaactgagtgtgggaaactcaagaagcagaacgataaagagtctgaggaatttaaaaatcctatctgtctggagccgtgagggtgttatcggccaaagtctgtaagaaacaggaaaaccacattggtaagtctaacaaagagaattgagaattgcttcataggcatgagacaacaaaagactataacttcaagaaacaggaatccctaaggctaggagtacaaggagaagagaatagggttactagaacctagaagcttggaggagggaccagagctggaacctagacctcggagcaagggactctggccaacagatcctgatggtatctgtggggacacagtgaggctgttttgggttttgcagggaggctggagcccactgctattagggtgaagagctcctgctggggtgatctgcatactcgggaaaaactcaaaggagcctgcaatcacccctacctcgttgttgccagcagcatctcatccttatgctgctgttgtaagatcaggaggctgttgccctagtctaggtgagagaaggcagtgacctggactggggtgatgtgtagcagttatttagtaatataaaatctgaagaatttgtgatggattacactggaaacggaaggaaagggaaagaacaaggacaactcatagatttcaccggagcaagtaggtgggtgctaaggccatgaaccaatacagggttccaagtaagaaaggaggggttgaagaacagaagtttaatttgggacgcctataaggcattcaagcaggaagaggggctagagcttgggggacataagtgatctagaaatatagtttggaaaacttaggtaggacagatagtagctgaagccatggaaatgagtaatctagcctaggagggtatttaggtcaccaaagagggcttggacaatgctggagcaaacttttaaaggaagctgtaccatacatgagctaaaatgcttctctttgatcatccacacgtacagccgtgaactggagaattatcactgaaatatgagagacagcaacataccagcagaagaaaagacaataaccttatcagtcgaaattattctggttgttgctaagcaatttaaatttgatagaagcataagtttacttctgaataaaattacctgtcaatttatacctttttatcaaccgctatcttccaccactggaaaataatgcaattgaatctgacactctctttaagaaagtctccacatgcatagccaattgcattttgatatggaattgcccccctttttaatattaatacttgatttacaactgtatattcatagttaaaaactaccattttattaaagtatatcaagttgttttattctccattattttgcttttcacttaatctttttaattcctgccccaaattagagtaattcactccaaccaaagcctattgtaaatgtatgctgctggctaagtgttctcttttcagtttaaaggggcatcagtcaggactctccattcttcccaaaactgcagagtgaaaagtacagctgcttctttcaaggaaagtgaaaaaaaaatgaaaaaaactgaagccaagtgttttgcttttctgttattttaaaattcaaactctcagaagagcttcaatttctgtctttgatcgcaaaagcaatttataaataggaagaattactaaagaggtgggatttatccttttcttttaatccagatttttctgacatttcaactatttctaaaaaaagatgagaaggtaagatctctgcaacagctctgcaagggtgaaataacagatacaaagctttataacatttttatgtattgaagtttttaaactatactagaataaagttacaaatttcaggtagttagcaagaaattttgcctgacttttgtatttttttctcctcaaatcaccttacaaagtgtttttaaatcgtgacaacctccagaatttctcattttatttgtcttgggctcataagtctctttcatagatatttcagcaaggattggaaaaggcagggtgaaaaaaagagtaagacttgcttcatcattttaaaaacatcagaactaaaatatattatggacataaatacaaacttagagtttccaaagtggatacaatttgtgcagctcaatgtttgatatctagatatatttgtaacatctcaaagcactctgccctgatttttttagacagatttacagaacccagcttaagttaacagaagttgtaaattatgtctaagtggaatttataaacaaaagttaaagttgagcatgcaagggaatattgaaaagtttgcataatgctgtcaacatctacagtgccaatgttcatcctttcttttgttattagctgaacttttttctgtatacatggatatatgtctgagtaagtacgtgtgtacagatgtatgttttcaaatgaaacaaagctgtgcagttattatcgcaggggccgactggtctctaggagcacgtgcttcccctggcctattaaaatacagtaccaacatttccctcctgtagcattgtgagtgtgatctgacgtgagcttgcgtttctgggaaagcgcctggagaatagcaatttaatttagaaactgctcagcgtaagtgttgggtagggtttgacggtactgcatcaggtgatgagataaattttcagagataccacaaagaaaggttggaaatgtcatcagagagtttatattaagtgtagttttcctacaaagaaattgattttaaacaccatttaaatttataatctgtgtcagatttcagtgttttattgcattacagaagttagatattagtaccttgttttcaaactgttttggtacctagtatgggctttttcttgaattgcaaacattgctattcttttggatactattaagctaatagccaaaatggaaattcgtatgtcatggagatgacaaatatgtctcctgctaattgaaatgctctaatgttgttaaatagtattttcggatatgtttactcttctatagcctttttcattcttattatacagtcagatgttaaaatatgtgcatatatatatatatatatatatatgcacacatgcatatacacacataattttatagttggattagacctagaatgtcttcaaaaaaattatgaaaaaattcctccttctccacttatcatcattatctaaaaagcatgcattcagctcaaattttattgagcacgcacaatgcatcttaagtagtattatatattgtccctgaaattaataggggaaaaatatttcagtctagatgaaaatcgtgttcattagtaaccgatacaatgttatttccaaggatactcaactttattttccttttgatgacactccgtggagagaaaaagttgtttaattctaaaattggactgtttcttcttaactggcctatcagcttgcttctcttcctgcctttttattgaatccatactttgtatttcagtggcccattaaattcttcctgctttttagagtttctttgaaaatatcttgtgaatactgcaggagaaaaattgcactgagtgttacaaatctcctgtattctctaaacagggacagaaatgtctttgggttttgtttgctttgttttgttttgtttttaaaggaaggatagaacattaacacatgacaacagtgagattacacagataaatttttgagtccttttatctagtaaacattctaatgacctacttcaaaggcaggctgggaagaagcctccctgtcctcctgccagaatgagaggcgaagctctttaccactcatatgggagatatgaggagactttgaatggatcattgctttttatgagtagtaatgaggtgagaagtattctagtgtgtggcacaggccttcattaagaagcgtgaaacagaatggcttatggttaaagggggtaatttgttctaacatacttgctaaattgtgttgtaaccatgccagttaacagcactatattttccataggattcctgagtgcatttgtgtgcaattattcttcccatacaaaattcagggatttttccaatagcttgtgttaactagttgacaatgctcactccttcagtggaaagtacacggagccccaccgttaaaaaggggtgaaagaatccagagatgttctcattctctttctaaagccaaagggttcttgtaaaatcaaaaattcacagaacccaaaattaaatgaataccatttgtccaaaaggtaacatcagaagtaataggtagtttaataactacaaagcttcaattttcaaatatgcattataattaatagaatccataagaaagaaaataagatttggtggtttcaagtccttcattaaaaaaaaaagacaagaaaaactgaaaagtaagagcaataattttgctacatttgtgaggaaattctgctcataacagaacttgaagttctacaacataccaagattgcttgttcagactcttactgggaacattgagctaagattttgttcactggaaaaatctttctacttagagaaacataacatgaaaacataacatgtttttttcacatgaccaactatcaaatgagaaaatgttgtaggacagaaacataaaggtttggacaagacccagaatttgggtatgtcatacgggaaaactattttataagtggcaactttttaagacacattattacacgggaaatgttataacattaaaatttgaggggaatatccctatgaattttctggaattttcttgaaaggcaataacacgaatatgcattgttttataaaatattttgtaactgatggcacaatattattgtaataaaaacattaattaaatataattgatagacaatcacagactgaaaatggagacttaaaatttaagcaccaaaaacctttacagtgaaacaggaagtattcatgtttgtccactctctggaatttttgagcctttgctgtgggggagaagaatttccgttttgtcactttccatccatttcattattattcagtttttgcacattcgttatttgatattttgaaaacaatgtttgcaatcataggtaagtacatgattctagcttcaaaaataaatactgtcaaacttaatagaaaccaggctgtgggcctccaataaatgtaataggcccagcctctcctttctacttcttttattgggttttcaggaaagtctatgaaagaaattctaattgcagctgctcctagccaatgcttaggttctcttccccttagagagggaaatggtagctctgggctatacggtggaatgagtggtttggtgtttgttttttgttttcaagctaattgaatatgtagcatagtaaataacaaaaattatatttacacattgcctaattttcctcactgcgccacaaggggtaaaccagatacagctgttatttgaatacaaaataacatcttattcaatgctaaattcactgacctagaatgttgcccagagagaacaaatctttttatcaatgtctgaatagttattctcagaatgaatttcacctttcctcaatttaacacaaatatgaacactctgagttaataagtgacaactaggatagaaaacctggagactgacataggaagaaatgtactttaaagggatatttaccattctttaagctttcttgttatttttacttcttttttttttaagagacagagtctcactatattgccctgctggtctagaactcctggcctcaaagaatctcctcacctctccctctttaagctttcttttgcattgtgtcttatttatatctgactggaaaaattaagacttgtgagactgataaaaagaagtaatacaaggattatattaatacagtgtgaaatgaatgtatttcattgaaactgttctgagctaagctggtctaattttcttatgacatcagggcttcccataactgggaattctcatagcttcatgatatcaaatgcctgcactggcttgcgtgtagtctggaggtttctctgaaattaattttttcaaatcaagaataaaacaaatatgaagaaacaaaagcataataactatcagaaagaaaatatgtatccacatatgttgagactaaatgctatgtaataaaacatgagtcctgagagagaaaatagctaaaatattccatgccaagtgtatactcacacttgagaaaagcttttattggaagagtactagtggttgcattttcataagaaaggtgaagccatttaaaaaaactcttgcatgctccaagcctctagcaggtgtgaaggtgacaatcccattcatccagtaggaactacctgggcagttgaaacgatgtgacagctccattctctctgttgtggacatctctacttaggtgggattaaagcagtagaatgcataggaatatctaaaaaaaaaagtacagttttattctgtttcatcaaagtgtctgaaaattgaggagtagaaaggaagagggataaatatacttggggcaacactggcagaagccaacattttaaagcaatcattgttgatcttttgattctcctcttttggttgtattagacatctttccaaatcctccttgtgtgagtctcggaaagatgctaagcaaacttaagcatttccttcatgacttggcacacttaaggtggtaccctagcctccccaaaatttgtcactgccatattagtcattacggtacttgaaattttacctctgttacatccattcaattacatctgaagatacccactcttgatttatactataacccaaggcccaactcaagcgacttctacacataaattggacttatacgcttctgcccatcggaacccccttgtcctggctagtatctgtatcacatttattttaggtggttttatttaatttctctacttactattagctttagtttgttcctagattgtttcatgataaactcctgaggacaaataacatatattacaatttacaattttttttgtttcaccaagagtaatatacaaacaaaaagtaatagaaaagttgaaagacacccagcactttgggaggccgaggcaggtggatcgcttgagctcaggagtttgagaccagcctgctcaacatggtgaaaccccgtctctatcaaaaatacaaaaaatgtagccaggtgtggtggcgcaggcctatggtcccagctacttgggaggctgagatgggaggattgcttgagcctgagaggaggatgctgcagtgagccaagattgtgccactgcactccaacctggatgacagagtgagaccctgtctcaaaaaaaaaaaaaagaagttgaaaaacagaagaaacacaccagcctcaatacctcctttcttattgtgtatattaatatcttttaaggaaagactccaaccttaatgcctgatttctaatgaatctcatagtgggaattactatctcaataagaagaaaagaaataaaattggcaaacagcagaagtcttgagatgagcattacttcatggtacttcttgagatttctcctatattacccagtctgcttggcattgtctagaaaaggagagagcaaaaaatgaaagcaaaaatgaatctgaaatgttagatatttggaaatgaatgagagactggtttgaagaaatataagagaacaaagacatgcttgcattttgaaagccgttttccataaattcttcaagagctgaatatgctaatttagcacactgaaccggtgatttgatttatcctgttctggatttctgtaatataaagaaattatactacagtgaatgtctaaaaatagcaaagtgcaaccaatcatgttccttatttattgaaaaccactaagtgaacgtgacatgagtggttctattcatgatattgaaagaattcctttttatacctcacagaacagaaaagccttttatccttttaatcagaacaacacctttccagattatctaacaagtcagaaaacccatttcttatagtatgatatggcatgttttaggttgctggtcaaaacctcctttaattaaattggtcatatatatgaacccaaagtatttagaattaaggtctctgtagtaagactaacccatttaattttcttatttatgctattcataactgaaggaaatttaaagaaactgctaaatactgcccattaattttctccttgctcaattttgatgtagaaataatttcgcttttatttgtttaccaagaagtaccatatttaggaacatttagctagacgtttcaaagctataaataaaattctaacttaattctgcaaactgtttcgtaccccaataactagaaccatagaaaataactggctggctgccaaaaagtaaggcgtgggatagaaagcctttctagtattcaagtttctgaaatgagaaatttaaatgaatgctccttatgatgtcaagaaatctccatcctgcttagtccaactcaaatatttccagttttcaagttagtatctctgtttaaaataagcaaatgtggattggtcttcagtgtttgtctggatactttctggcagtggagaaacgggcatgcaagggttcccagattcaccccacagcctcgcattagagcaaaggtgttaatttcccttgtaatttttccttctcaataacagcatgctcaaacccaaatatttctcagtatattattacaattttaaaaaattgctggcttatccaattctgatctgaaaaacctttctctaattagtgtctttgcaaaactgaactcaggcaaattttaatccctcatttactgattttattttaatactattactcagcatatgttggctgcattaaaccattacagtaaaaattaaaatgaaagtcatatgatttattcccctttaaaagtgctcaattggtctagtaaaagtcaagtgccaaataccagatgtcggatttaaaagaaattctgaacaagaaggaaaaaaccctcccattactctcttaagatatttagttgaaattaatgccatcccagaaaaaaataatattaacatatgaatacattagtctgaatatatttgatttaagaaagaagagatgcagggaataaaaataaaaatatattaatatttattgatttaaaccccgcttttgaaaactacatttgtattgctgttacacacaattttcaagccaacttgatattttacaaagaaaattagagtggttgtttcaatttagaatgcagaaggtcagaataggaagacaagaaatagtatagatacttatatcaagtttttattacttttcctccaaacttttgtttctcctcactatttatcagcataatttttaaccaaaatccacttcctggaaaaataaactgatgtgctgaagttaatagaaagatatgttcaaaagaaatagccaaataaagataactaccttttcagttcttatcatactttcaagacagctatttcatattcaacactcctaaaacatagttattccccaactccagatctttgcctacattacttttttctttcaaaaattgctgttctctttccaacagttaagacctacacctcaaagatggtctaactatagcatttcttccataattttttaaaaattattcctcccccacccactctgccataactacaatgctgctatagtggtcactggctagcaattcccaaaacactactgcctttctccctggatgcggcaagattacagtccccggctttcttttttagtaaggtatggccatgtgaaagtagactgaccaatgggctgtccgcagaagtagttataccctctgtatgggtatttcctttcactgtgctggctgcatttgattggcagtatgatcgtggcggaagtccgtgctggaggtggtagttctggggttcctgatggctccatgcggtagatcctgccctcctgttcaccccaaaccccaaacccagccctccgtcctattgaactttacatagcataaaatattatactgtgtttatccactgagatttctcagttcctcagcagctgacaatatcttaactaatgtaagtaaaattatgatctctcagttgacagaatatacataatattttgtgtttttcttgtcactgcctatattctccttatttgttaatgatacctcttctgacaagttccttaaagtcaggaactcctcttttttttcagcttttattccttacagcctctggtaataagtagatgcctaatgaattgctctttatctgtcaatctgagtttattatgctacccaaaactaacagtctcttggttcattcatttattattttattcatttatttatccaaaatatctgttgcatctttgccatttgtcagtgcattagacacctttgggatatcttcccagctcacattaactccccattcgtaaggggtgaccttcgacaatagtctcagtgcctaagcttgtggctgacttgaccagagtacattatctcactcaagctgggccagttagatccggtccccaggcaagttgctaggaaatagctagttcatcctagctcatgactgaaattgtactctacctacttgaaagcattggcagctatgtaatgccacattgacctaagaagcccaaaaaagtatagagcaaagaggaaaaataaaataagcacccccaaaacgtaaaaccctgaagcctctccatggcctgtctgcaattatttccttagaccagcctgaattctaccactgtgctctatagcttaactatacattacctgttttgtataagctatgtcaggatggctcctgttacttgcaactaataaaattttaattaataaaacaagacattttgcttttcccagggatacaatgatgaacaagagatatatagctcttactcttatagtaaaaccagtaggtggcaattcagtaactttgcaagggaaaaaaatgaacttatttttcaaccctctcagatgctgattttccttccttttgaagaaaaagatttgggggtgattttcatttgtgctacacatgaaacaagagttttattattcatgataatatcactttctcctctcctaatgttttttctcttgttattttgcgattccaaagtgtaacaaaaattgtaaatttaaacatcggaaaaagaagtcaaatacatctgtgttgaaaagagaaaggtgggaaactttgaattggggtgatggtaatggcgatgtgacaaagtggaaagatataaaacattagtgagatgaaagacgcggaacttaggaactaactacacacaagaacaacagaggggagaaccaagatggctgtgtttcaagcatgagtcactaggaaaatggcgcaagaccaggatgctggttaaagggaaaaaaatgacacatggcatattgctgcatttcagaaagtctccattctcagggtacatcaagatattttggagatctttgaaaagatacaattgcccctccttcagccccagagatgatgaatccattggtcaggagtgattctgtgtattagtgtttttaaaaacccatgttgatgggattgagaacaaaattcatttgaagtgtctggctcttccacaaaagtatttgcttgtttactttctaaaagatgtttcttagtagactctggggacttcaaaagtgtggagggaggaagagggcaagggttgcaaaacttcctttgggtactatgttcactatttgggtgatgggttcaatgtcagaaacctgcatgtgtagcccctgaatctaaaattttaaaagaaaaataaatcaatttaaaactaaaaatttttttttatttaaaatagtaaaacactgtacagaaaacttgaaaaccatgccacttagtaatatggagttgaaaattaaggcagaagataagaggaggaatgaaaaaatgaaaacaaagcaaaatacctattaagtaatacagaggatggaaaggaaagggtatattctgtaagtcctgcagtttcttttccttacctcagatactgaagcttctaacagaaaatccagaagactctgggaagtaggtgaggtttgacttcaattcctcttcttgctgaattcccaatctttccgtgcctctcacaccacactcagtaattgcctgttgcttttacttacacagacactcctaatcactgacttcagcttttctcttcattgctttctgggatggaaaagaaggaatagttagctagggaattatccaaagcatcgttaataattacctacaaaacaattcgcttctatagctactgaatgaatgaataagttgctacataagaatcaactacaattctttcctttttctcctcttcaaaaggaaaaaagagaagaggcattatctactatttattaaactgaacttaaacaagagatgaaacctaacgcagcttctcctcccttacagaataggtaaaacagatatgaatcagtgaagcagaaaccatgtaatagaaaaagtggaatataatgaatttggatttgatgatgttttacaagcagatatcgcaagtcaaatttcacagcagtaaaaacaacagaagtccacaaaggatagatgaaaacatgtctctctcctgtctctctccaatctctgtgtgtgtgtgagagagtgtgtgcgcgggcgtgtgcgtgtgtgtgcgcgtgtgtgtgtgcgcgtgcgtgcgtgtgtgtgcgtgcgtgcgtgtgtgtgtgtggtgtagggagagggatagattccttttcaaaaagtgtccagagggggaaaaaaaatgcatcatgccacctagtggcggaaattaagttgattccttttaactcgacaaagcgactttgcctttctttagaaaatcagatgaattcattaacatagtggaatcttgatttggcaaactacacagtagttaaaatgtaaataccaggtctatgttttaatttttcatccaccaatggcattaagaaatatgatgaactttaaagagccctgaagtcagaagcaggatatctttccttctctttcgaccaggtcacttaaccaccctggagctcagtttcctccataaagggccagaatagatgaactcttagctcttcaattccatgtttcaaagtatgcaatagaccacataatcagggtactcttatctaatgcagttccttgtgacaaagtcaggccaccatcttcactgattaaacgccggatgacacaacatgccttctacactttcagcctcattccagtcacattttacagagtccgtgcttcattgcaagcctttctttattactgctttgcattattggatgtctgctgctgagagtccctagattacaattcttaacttctgtgaactgcagtggtgcatatttgtgatgtatttttctaacttacgtgaatgtccacaaattcccctttgaaatcaagtaaagtattcctccaagagaaaaagaaatagtttggaattatgtagcaatatttttcagacattgtgaagtataattgcccctttctcccactctcactaataatatacatccataatgatatacatctgtgaatcagatttagaaagggcattaaaagcaacaattaatctgggctatccagaatacataatctcctactaactaatctgtccttgtaacttagcgactaaagtgtgaacattttgttttaattcaaaaagaaataaaattttcttaaaatataagattttcttttttatttattttattttatgtatttatttatttactttttgagatggagtctcacactgttgcctaggctggagtgcaatggtgcagtcttggctcacttccacctctgcctcctggcttcaagtgattcccctgcctcagcctcccgagtggctggaattacaggtgcccaccaccacgcccggctaattttttgtatttttagtggagactgggtttcaccatgttggccaggctggtctcgaactcctgacctcgtgatccacccacctcggcctccaaaagtgctgggattacaggtgtaagccaccgtgcccagccataatattttcattattccaaatgtgatggaaaacccataacacttagctgatgcaaattgtttaaaaagtatcagatacatagatgaaaagtctttttagtcagatatttgactttctctgcagcaaagccttgcccctcaccctcagccccagccagctgagggaagagtaattagctctccaaagagaataagtggttaatgcaagaacatgtttatttgctctaagaagactgtcttaaggttatattctctacccagattgcatcttcactgttgacaacacagtgtgtcacagatgaaattatgcttggggtaaaattagtatttccttctccaaactggagattagaaaataaatgggtcaagcataggaatgggatagtacacacattagcattctatgaacacacagagggactggcaattagattcatggtaaatattgctgacattcccctgatgcaaactcacaaatataagagagagaattttctagaacatgcttatcaatgtatttgtttctttgttcaactcccttcttaacattgtccagacatcctttaagcctccaacctcccccaaagacatgcatacaaacatatccaaacacttcattttttcacgcagtaccttataacacctctatttaagcctttaaatgatatgtttacttgtctttctatctcactagactgttaattacagcaggcagggaccttttctttgttaaacttaggacttactactatgactagcatatagtaggcactttaacacccttgattgaactgaatgtactgtgttaatttaaacagtgcattattaatactgggaccagatgagtctatcttcctcctatgtctcattgctaaggagctgtggattctcaatagtagagtgtcacaaagggagcagcctctacttcatttggaactattacaaaacattgctttcctcatgctttttttagagtatggacaacaaaattcttttcatactgttatgaaacacttctgatagctgggcaacagctaggaagtctcttcagtgaggccagaggcaagaatcagaggatgttattcccttcatttccagcgtattatgtggcaggacaaaattttaaatttccttcaaacacttcattccttcccttcttcacccatagtaaggaagaacttttagcataatgacacactgaagttaaacaattagacatggtaaaatttagagaaagatgtttgtttcattgtcattgatatttttactgttcgaatagttcactctggaaaaatctccaaagacaacctgagcttgttcctaggatgaatttatctattcctataaatggagccaagaataaaagtctcagagcctttgaccttagcatgttactaaacagaagccaggaccttggagcaagggatggagtaggcagatgggtagaaaaaaacaggagaatggccccttgacttctgtttgaagtgaactctctgaactaaaaggtgctgtgatggaaaaacacttggcagcactttccagattctatgcatctttataataagcaaacattaagattatttttcagtaaaatcatctttctgataatggtctatatccacatatccttccagatgttggaggaaataatgaagtgattacagtcactggatttctagacaaagctgaatgaacagcaatcttggggggtggtgtttattaaggcatcagcaagtttaatatggaaggaagggagccatttcacacttttctatccaactagtagctagcttgtctgacattaggttgcttgtggatgcattgctttgtcaaatatttttagaactttaaaggaaagagcacttgttgattcctcaattggattgtccacagcttgaagacaagccgaagacatggtgatatttattgtttccttctatctcctctgcaatcttaaccttccactgtcatccacagatagtatttctccccaaaacaaattgtacatgtggataaactcttgagtttgttgtgcacagaatgatgctaatactggaaggagtttaaagagtgcagcagggtggtagaaaatataactgtcatgatgaaatgtggaggtaattaaggcaagtgtaaagaattacaattttgtgcctgatgatttttaaataataataatagtcactatttaccgagcattgatcaggtgcaaattaccatgctagatcattttcatatgtcacctaatttcattctcacaaacaccctgtaatattgaatattactagcctggactggagggactgacttgcccaaggtcactctgtatgtaagtggcagagctggtactcaaacctggatctgtcagaccccaagttcctgatttcagcttctacaaagaaaaacattttctgtgcttcaccaggagtgtgttttggttgtttgtttgttagtatgtgtatctatttatgtgagagggattgtagttttactcaagataacttaagaaatgtgacaatagagatagatacgatattccagacaatgtaaagaatgtcatggtaaggtcccaacaaaatatttttaaatcaagggtatatttcgccatattttttactataggaccaagattcattttatctggggatccaaatattcatggctctatttgtatgtctcacaaacctggagcttgatgagtccaaaacaaagcactaattttctacatcccatccatgtccccttcctcccccgcttattcttaatcttggttgggggaacaaaaatgaagcctccaagacagaagcttgagaatgttatttaactcctgactacgatggactcctcaccaatctcacttttctgcctcctatttctccatccccttcttctcagctcctttttaggagtttccttctgcatgcatctcttccttgctagtgttcctgcactcagctttcttctcacttgtctctctcttctctccttatgtaagtccactgatgcttaatgctttgcataccatcttaacatgctaataaatcctaaatctgtgtctccatcctagaattttctctttctctatcttcaacagatacccaaaaattaagatctctaaagcaaaattttgttatttccctcctcagaatctgcacttcctccaatatttaaatggcattaccattcataaaattgaacaagccagaaacatagtggcatatttatctctcctctttactcttcccatccctgcctaaacaccaaacccttcacaagtcctgcttacccatctcctaaacatttcctgagtctttccacttaataccatcccctttgccacagtttcctagttcaacgcccccatccccaaaattctttcacacatgttattgcccagcaccttagatggtcctcttgcctccaggcttgaaaggaatagatcctttcaatctattctctatttggggtagagttgctggagcatgcagagagtatactaaggaagagaacaggcaggtaactgactctactatctcattctaatacactatatcttacagttagaagaaacattaaaagccatttaagccaaccattgcattttagataatgaaatcaaggccgatgatatgcataacatctcttttctaagtcagtactactcctttacaatttacgctcttacattctgttgagtttcacatgttccagtcaaatgaatcatgcccttttctgaccagatattaaaatgaatccttcatagtcagaaacgttttgaaggtaaataaactgagtagaaaactgggagcataagcccctctgacaatagatcagagggtacttacttctcccactgtattttttcacatacagtcaattccgaagccagtggacgtagttgattgcacttagagggatcctcacttttttgccttgtgcattttgctgtgttacatgtgactatatgaatataaatttaaattaatgaaatgaaatgaaaaatttagttcctcattcactcaagccatatttcaagtgcttagtagccacatgtggctcatggctactgtactgggcagcaaagatgaagaacattttcatcaccgcacacagctacattgggcaacactcatctagtgctctgtaaaactgaccacaatacctcctggcctagattcaggtaggaaaaaaaacagccttgaatggagtaattaagagaaggaatagaaactttggaaaccttagccatacaataccctttttaagaaatgctactcctccaaatcatgacatcatgaaaaattgttttctgaatgaaacaaagtataagcatctatggttggtatggttgaagataatcaacaattttcattgagagaaaatcaagatcccaaacatgaaaaaatagacacctttccctttcagtgcctgttaagaatccaatgatcaaaagtaattgctcattaattttacaatcagaggtagtgagaagggtcaaaaagtcaccagggcctgatagaaccgtaaaaatgagttttgcagagacatgccaagaaatatttgaaatcactgaaaagaatggagcttcactgagctgccgagtcctccaaataatgaaaaacagcacaataggccatcaatttcaacagcacctaaatgagtcacatattatggctgatatatatcagatgtatttttcttttatttttatataatgtcatcttttaataaaatgttttattttaaactttcatttaattaaataaattcaagtaagctttattaagaaaaagatggcatcaaaccatgtattcataacttttgggctagtaaataaatatggtgtccatatgtgagttgaactatgaaattgccacaatttaactatttttgccttacaaaaacagcaatttcatatgattcaactacctgatttagaaaagctatttttaatctttgaataaataaaatggagtgtatgttagacctgaagaacaaatatcattttgccccagtattttaaatggaaaagaacctttaaattctccattttaacctttagtctttatgattctctgaaatgatataaaagaatgttacaaaggcagcactatctaccccctaaatctgctattgcttgtcaaatttcaattagtgaagggaaaagcatgcattatagctgtaatatgttgccttgaagtttaattttcatagttctgtttttccagtttgcagtactgatggttcaccttccttagaaaaataggtataaggcaagtagcctcaagcagtgtgtaacaagctactttatatcatgctcatttaaaatccatgcttcctcaccactttttaagttgatcagcaaggagacatcagggatgttggctttgggtctgtgggggactgacgtagattagtatatggagtcactgcacccctgagcccagtttgtgacctgaaatatggtcgtgaatttaagctgatcaccaggagttgtaaccttttggattcatgcctcacagaaagcattagcccttcacctgaacttgcaactaaggaaataaccttattggaagacccatggcaattggggctgttctggttccatcaggagccgagagatcagagagccagcacagtccactctcacccccagcctctacagttccattcccaaacctcagagaacacgctgccctgctggcagcaccccttccactttcctgtaacccacacctcctgctggagacactcagctgctgctgatctctgaggagccccacaactgcggaggtgatcctttctaccaagaaaggtgtctcagtgcctagggccactggcctgcccccatcaaaatctgtactgtcagccaagaggaaattgaaaaagctttacaccacagggccctagcctcataacctagcatgcctttcatggaacatcaggttaagaaatgagcatctcaccttctgaagatgagtttctacagggagcggcagaatgctggcaatgtggggagttgggagccacacccggctctcatgatttagacacacctccactaagctgccctttaccctccactgccattgacaatcagagttacgatggaactcggcagctaacagggaaggcttggaaactgggatgggatttgagtggatttatgaactttctgttacttagaaagtggggatcttgcgtatctgaattaggaggactgtttggagtaaatgaattatacttttagagtgcaaggtgaggctccagttacacaggcctttgtgcttaatttggtttcacgttctacttcttatagatttatcaaacaatgattatctaaaatgaatatctagactagcagctttggtcaaaagaagggattcgtatagaacatctgacatgattgtagacatagaagctcaccatttttttttaggaaaaattgaacatcagatcttgtaggaaattttcttaacaaagcttagaactgtcaaatgtaacaatatccaaaagtattttaaattggttattttatctgcccgaactatttaattttaatcaaaatcttaacaaagttttgaagctgaaataatgatcacaaattgtttgggatcatgtgtggatcatggggaacatactgtttcttgtttcttcttttatttttttttttttttttggagatggagtctcactctgtcgcccaggctggagagccagtggtgccatctcggctcaccacaaactccgcctcctgggttcaagtgattttcctgcctcagcccctggagtatctggaactataggcgtgtgccgtcacgcccagctaatttttatatttttagtagagatggggtttcaccatgctggccaggctggtttcgaactcctgacctcgtgatccgcctgcctcggcctcccaaagcgctgggattacagccgtgagccactgcgcccagcccactgtttcttctttaaccaagttctatggtagtcatatacaatgctttgtattttacattcacaccatctgtattaaaggaaaatattcagataataagcattaattaagaaaaactgcttccaatggccaaaattgggacaacatgggcatcaaaaaagtaaatgaaatcaattaatacacattgaatacatatacattttaaaagtttatgtttctgtaatactgcaaataaatgaaaaaccaaacaactcaaaacaacctgtaggcagcataggaaataactagagcaccaaatcttcattgttaaaatatgaaaatcaagatttaagctgacttaaatgtataaattacctttgcaccgttcttgtatgaattgtatttccagccatttttcagacaggtaaatttgattatggactgcatattaaaagatatgatattactcttctttttatttggttagattgtgcttatacccatatgcattagtatggaggggtaaagtgatataattactgagttctttttaaacgtcaactaaaaaaaatagataaaacaaatgtagcaaaatcttaactgcataatctggaaaaggtattaaatgtgattcattgttctactctctctacttttgtcttcagttgaaaatatttcaaaacaaaaattttgtaaaagaaacatttgctttttaaagtttcagttaacaccagtgtatttgggtctaaaatataccgtgccaggtagataccacttcctaaatgctctcaaatctgcccacttctctccattcccactaatgtccttggacttttatctcttgcttcagcaaatgaaataccctccttttaattgtccttccttactcaaagcccatcatccatgtggtgtgcctttggccctagccaggcaccaaccaaaggtgctgaagcagcaatcgggaaacagtcctataagacaggtcacacaattaagagaggaaagaccagataaatgagaaaatatgcagaattcaagaggttctaatgatgtagggcttttggggttcactagatgccaagtctaggggagtatgggccattttcatgtatcatggcctcttttctgatgtatactcttctcattcaccaaatattaggtgctcataggagtctaccatcaacctctggttctcatcatgggttttgagggatgtgagcgagatcttcattctgtgcagctggagagtatagtgtctctgcaaggatggatcaaccacagccatcccatcatgggctagcagtgccatgagccaccacctcgaatggccatttgaatggtttgtccttgctttcatgtgattctcagtctaggaatattttcttaattaataagtgtatttttctaattttccttcaaataaaatataaggtttcaaaaagtgtgaatttgggggcaatttctgaagcagagagtaggataatgtttagaagttaaggtggcatggaaagttgctttcttccaggtagggggaataaaatgcacacaggtgggacagcatgaggtccaagagaactgcatatagttctgagggtctaacaggtggttatattgattatctcacataagcccttatgggcactaagctcgttcaagggatacaaagatgaagaaattacgttattcatacactaatgagccagaaacatattgaaaatgtaccatgtggccgggtgtggtggctcaagtctgtaatcccagcactttgggaggctgaggcaggcagatcacgaggtcaggagttcaagactagcctgaccaacatggtgaaaccccatctctactaaaaatacaaaaattagccaggcatggtggtgcgcgcctgtaatcccagctactcaggaggctgaggcaggagaatcacttgaacccaggaggtggaagttgcagtgagctgagatggcgccactgccctccagcctgggagacagagtgagactccatctcaaaagaaaagaaaatgtaccatgtgccagacactgcaatagatgctgaataagacatggttctacttctctgacttactattgggaaattttggtgctttgttcattaggctgctgcttggggaacaggaggtccatgctcaggtttatgacctcatatcagtgttgacaagaagttaactttcgtaatttttttcaacatcttttttggtgcttaaaaaattgaatataagagctgttccaaaaataattactggattagaaaagttaaaaagcatatgtgtgatggaagattatgtttttaatatatatgaactttgtatgagagaaaactagtacatattagaaaatgagataatatggtagtttaacaagaaaagactggctagggcgcggtggctcacgcctgtaatctcaggactttgggaggctgacgtgggcggatcaccggaagtcaggagttcaagaccagcctgactacttggtgaaaccctgtctctactgaaaatacaaaaaaaaaatagccaggcatggtgttgcgtgcctgtaattccagctgctcaggaggctgaggcaggagaatacttaacccaggaggcggaagctgcagagagccgagattgcaccattgccctccagtctgggcaaaaagagtgaaactctgtctcaaaaaaaaaaaggactggctaaaattaaaacctcataaggtactaaatgtaagtcatttctatcatttaaatttgcatttgaacccaaggtgtgagtgacctgaggataattttttattatagaattctaccacttcaactacaactgaacccaaatttcacttgcaatgcatttgtctttctccttattgattctcaaatcacagttaaaactgctaatttaggatctaagatcaggaactggatggattgaaggagtattgcagtgaacgtgaacaatgactactaaatgttcatatagaagggggttaaagagtagtaaaataaattcttgtaggttggggccaaaaaataaaagctcatacacatttgtttgatcttaatgtcactaaatttggagtatgtttcctttaaataaatgtaggacactaatctctttaaatttcaaaagggaaactttcagatgtgctattagtaaatgtgctattatagtaaaactccaaataaatgatgggtggaaatcaagctgttagtgtaaaagcaagacatctttttggctttgggcactggaatattgcctttggttgatacagcacaaaaactagagaaatgttgcaaaaaaaaatgttttaaaatacttccaggaatagacagctagaatgggtgggccatacttctatcttaatggcctgtacatcaaaaagtttttaactcaatttattggaaatgattttttccactggaaatcatcttcactagaatccaaatagaaaatggattcgcatttccaatatttgctttacagtcattaacatgtttgtgttgtttaaagtgacgtttgctccacttcttacaattgtgattgtttctaccaaacaacttcaagataactttaaaacaaattatttactaaaacagaaggaaagtaatgcaagtcctcaaattataagaatcactgatggtgaaatatctctattttaaaatttaataattagaatgctatatttatttagtggatataatgaaaacacaacattttaagtctgttaagtatcatcttactaagtcagtgttaccttaagaagtaactacttaccttagccacaaaaacttttttaagcttacataggttgcatgaggcatcaaataactgacactttatactttaaaagtcaatccaatcaaagaagagaatccaaaccaattgttttacggtgggaaacctggctgattatagacactcttctgagacatacagccacagctccatttcgacagcaacagaaaaagcttagcaataatccaaacatacatgcaacttatgccaattatttgttattttcctgttttggatacaatttttacatgaatatataacatataatttattcgtgtataaaattttcctaccagtaatcaaactaagaaaaaaaaaacataaaataattgaggatcattgagaaagttacatttcaggataccaaataatggaaatcataaaaaagatcaaggttatttcagttattgaggcaatatgacaaagttatatttggttaaataatatacactctattatgacaagtaaaataatcagtttaagtctaaaagtcaacagtacagacactcttttgtgcttctactaatgacaattttaaaagaattaataatataatttacttggaattttgtggatctttaatgtttagtaatgaatgtctctttgttacttcaattagtaactcccccaaattgcaaatgatccaaacaattatttgtacatttttccaaagagatttttcccaaatgtttcaaccatgaggaagaaaaaaatatatatatatatataataagaggagagctttgtgtaagtaataaatggtgaatatattctatattagtgtttattgaaaatcagatattaccaaacaaaatgttgaaaatgtatttatgtacaaatcctctttgtttgttttttaacattcaaagatcccactatgactttaattctaggattatacttttggatttttttttgttatttattttaagaaacagctcgtatctttaaagctctggaatggtgtaaatcattacagtggtttcacattttcatgggatcaaggaaacaacagtaagctcataaaacagataccactaattatgcagagaagaagccataaagtcactgggagaagcatgttttatattcatgaacacatcattaaaagtttaagacatgctatcaaattctacattttaatactatgcccaacagcattaaaccctcccaacaagaaaatcagattgtttaatgatcctttttgtgtcacactggttttatatgtctgcagttgaagcagatgtggaatttgtattgctgaactttttttttaaatcattggatagttaaaaaatcatttatcctttatatctagttaaaacaaagaaggtctgaatcatcttccaatgtatatctcttaaataaaatgtatttgttgaggtaataagcctcaattccatattgcatgtattttttaaataataatttgggttttctttagaacatgtaaaaatgtaaaaggggttaataaggataaaatagcttccattttaaattaatttttaaaatgctaaataaaacagaaatcaaatgaaatcaaattttatgaggccatatgaaaacacaaaagtatgtgatatcattaagagaaatccaagaatcatacaaaatgttaataatattacagacagcaattttaagagctgttcatagaacatcacatttgccaccagtgccgcacagatttaaactgcagcctctcttcacttgcccacaaagggactccagatgcgctaatattttaatttgcgtgtaattctaaaatgtttccatttgtacataataaaatgctcagcattccacaatttaagcacatcttgtagacagctcagcaatacacactttcttggatgggattttacatagtaatatgcttcaagcttaatctcaaagtgaaagtaaaatggagttatgacaaatttagagaggaggccaaaaatgctgcaaatgggaaaaaattaagtaggggggttagttgttgtggacaagaaataaactatataaaagtaaagacattgaaaaatacttaaaatgtataggagagatttatgccccatggacagagcctgaataaaagagccaatcacttcaaggaatttagtggggattgattatttgaatttggtgaagacggtgtgtgtggcatgtgtggcgtgtgtgacggtggatgtccatggcagaagacaggaagcctggggctgctctcctgctgtctggcttggcagttttactttgctatgatttcacctacattaagtaatttttgattgtttttcatgtcttgtagtagacttccaataatgaagatgtgtggataaaatactagccaaaaaattcgcaagctttgaattttggacacatcaaatcaggatagacattgaacagtctaaaagccacaatatttattataaaatgtacactagcatgttgcagcaacacaaatcgataagcgttgtggactacaaagtgaataaaacaataattctattgaactgaaatatggagggaaaggtagacagataatgagggattattattatatgccaatttactgtttgataaaactacattcaatctatacatatgcacacacatctacagaattgcaattactgtcaggcattatcctaagcatgtatattaatttatttaacatgtactgatttgtttaacgctttcaacaacttaagaggtaccactattattgtctccattttatagtgaggagactgaggtaaaataatttgttcaaggtcccagagtttgtaaatggaagaattgaaattaaaaactaggcaatttataaaaagttctcggactatgatgtaatattagtctattccacaaatcgggaaatatataaacaaattactcaggctttaaattatctgtaggtatttttataatgcatagagatacttattaacatttctaagcttgtgtgtttttttctatctgaatctccacctgtgagcaaatcttcagtgttaggtatctaaggacacaatgacttcagggctaaaaccattgaaacctgtaaacatgaataaatgcaaatttggtcctttggggttaactaatatgtaaatgtttttagtgaaactactggtatatagacaagcacagaacttttctaagctttcaggaatcagcttttacaaatgctgagctggttttaatttaagcactacaagtgaaatagaacaaactcggaagaaaacatggttactcatttgcatctccaatttaataacgcctataattgtccagttaccaaagttagatccaaatgctttttctctgccaaacgcagctgctcgagaaaccgaacactgatttgatttttctgcagggtacatgttcactcgcggctctcatgatgaataaataatgccatgatgccgaggagctgcggaccttgcccttctgtgaaaagggctgcatctgcttattctcagacattcacgatcctaaaggaataagacaccagaggcctgtgaataagagggccttttcagacttaacaaagccttcgctcctgaatccaccttaaccagttgcgagaaaagagcttttggcaccaagtcatccttcaggaaaagactgataatgatcactaaagacatactcggggctgctgcctcactcacttcaaaggctttctctcttaatcaacattaaatcatcatttcgccagggatatagggacagctgtacacaatctatttattttaaaacagattacaaccaggtccctctgccaaaatataaacttcttaatgttgcatgttacttcaatatttttcaacttggaacttttatttctaatttagtgtcccaaattagcatttctgtctcagcttatggactgcatcttcccacaaaagctgagctaataattttatcaattatacagataatttaagcaacaaaacaaaatagatcaaaacaagactttacataaattatccaaatattttaggctaaaaaatataaagtctccattcgctacatcattttgtggtttgtacaagacacaaggcctgtgttattgtcttattggttgttattaaccacttgatatttcgtcatgccttctctgttcctctttaaaatgtagacccctgtgccctatatcttttacctttgttttggtctcatgacagctgtaaccctcatcttacttaacctcgaggaaaactacaaaggcatttttccccctacaagctaattctttaaaaaagataatgatccaggacctttatccagtttatcacttcagttttatacaaaagaatattaagctacaacatataaagttaatcaatgatcatcacttcaaaaatgtatgtagtaagtaggtacaattaggtagatataggtacaatttctgctactttgaattataatcaactaatacaatggctttgcttagttaaatttggttcaaaataatatcattaataatgcaagtgattgaagaagatgttcatactgtataatatttttattgattttgagtagttcacctttgttgatagtttattatgagtcattgcccactttgtgctgattactgaatgcaacaacacaaaataatttttaaagttttaataaattactttgctacagtattagataagaatttaaaaatatttactttggtcctataattccagtatctcttgctatcaacattttataaaatctcttacattatttgttagagatgtagaaagaaaaaaattaatgtagattataattttcttacttaaaatatataacagaagatagcattttataaatctatagaatcttaagaaagtcctctctgctaaattaaactttttcagttagaatttatattatacagacagtggtgaaggcttttaatgtttattggagagattcacttaatttccattgtctttcatcatccagaggggttttataaatgaaaacccaaaacatgaggaaatacagaatagaagaaattaaagacaccagatggatgagcacctctttttttccactcccattagaaagagtgccaactgccaggaaaggcaggtgccattgagtctccttctaagagtaaacagggtctggaacctcctaccccaaccaaccccatgggctaaccatagaaagatgtaggagagatccgcaaatcacagctatgccactttcacaccttccagtgcaggaggaaacttctgcctctgtccatatttcaggtgctgacacatttcataagtgccgtaaggaaagttcaaaaggacttctacctgaagaccatgctaccacagcacagcaatggatgaataggagtctctaacccagctcaggagatctggaaactacttcttgtttttttttttttattctgttttctcccctttcctttttctccaagccttcagccctcttgataaaatttttaatttgatgacccacttaattcttgagttttcagacagccataaatggtacagttatgaggcagtataacccggcaattgaaagcatggacgctagaatcacatgcactgccagaattccaatcgtggcttagccactgtctaagggtgtgcctttgagatgttacttaagttctctaatacaagtacttaaatacttgcctgtaggattgctgtgagaattaaatgaggaagcatgtaaagggtgcttagcacagtacttagtatatagtaattgctcaataagcataacatattattattatcacctcaccataaatagcattcaggtctgtgagagaatagcattaaagctacaaaataaagattattaattatagggtgatattattattccgtatctccagtttgcattcaccctaaatagacagctcttgttgctttcctgaacaaaaatgaatatgactccaaaataataaataacttttagaaaccaaaattggaaaagaagaaaaatttactttttggttgattgatatgaagttgtaagaggctgcctttggaattcctaaagagatacccatctcccaaggaaagcaatggaaatcctttgattgccgcattccacaaaccatcatgaaagtatttatttagtctaaaagcctaactagttcatcatctctagaggtttcatatctaatagtttatccttaagctcaggaattcatatcaccagtggaattttttccatcatagtgaaatagctgggtttcaacactaaggaaatacatgcaagcattttatgactggacttctcagaaccaaactaagaattctattttaaatgttacatgatgcaaacatttattcttcatcttttcttcatattattaatcaagacatttctcttagttattttccttgaaataatattttattggcatctaatacattttatttttttgaaaataaatttatattattttgtgtatttttatagccaacgttgcacaaacttgaaggcagtattttgaaatattgaaatatcagaggcctgaatactgaacgggggaaattatggacaactgaaatattaacaaagcatgtattcgaactcctgaaacccaaaataataatatatactacgacaagaaaataattggcaaaaactttatttaaaagacacccaatgaaataaccagaaaaggaaaaaaatctccctaaaataagagcatattagcattgatttgaataaattctatttcatgtccttttaaaggggaatattgattgaggtatttctaaaggagtattgataaaggttgtgtaacactccaaaagttatccatgcagtataatcaatatacacattataacagcatagaaacacataaaagaagcataccagggcattatcattggggtaattttattttgggtaatcgaactacttaaagtaaagctagatttacattccttgatgtagagccagctaagatgttaccaaatctggtacccacgacttcctctaatccctcctctttattttcggtcatgtgtgtcccctggtgtgcggcaaccccattttatcctctgatgctctgcggcacactacgcagggcagagttccctccaccaaaatatattccctgtgaatcttactattgaaagctgctcaccactgcctggaaaactatctgacagttcattcatgattagtgtgactagctgatgaggtggttaagggaatatctagtttaaatattgtatgagtctatgttttcatgtgttaccatttccaagagttaagggggtgattccttaacaatcgacaattccaaattaatagtaaatgctgaaatttcttgctggtgagagctttctgaaacttgtaagaaattacttgtttccgccgggtgcggtggttcacgcctgtaatcccagcactttgggaggccgaggagggcggatcacgaaatcgggagatccagaccatcctggctaacatggtgaaaccccgtctctaccaaaaatacaaaaaattagccaggcgtggtggcaggcgcctgtagtcccagctactcgggaggctgaggcaggagaatggcgtgaacccaggaggcggagcttgcagtgaaccgagatcgcgccactgcactccagcctgggcacagagcgagactccgtctcaaaaaaaaaaaaaaaaaaattacttgtttcaccattatctgttgctatgcaattgatcacctgagacaccgcatttgttacaatacatccttttattcatagcatatagatcactccttagaatgttcttacattgtgttaaaaaaaaaaaaaagctatatgaaatcattccacctgaaagaaagaaacgagttaatgataaccttctccaacattttaatgatctctgagggagaatacattaaagtagaagaatggttcattggagattttctaagcttttttatacataatgacttcagtccatatatgagaaaataaaactatatgaaataattttatcagcaacgaaagttgttttcatacaaagtgaagaactcaagcaatcattaaaagaaatgtcctccccaaatgctcaatttcatgcaatattaagacgaaatgactttccagcttgaactatgtggataattggctcaattctctaatttattttgcaaatatagtcaccatcagaataataaaattatatctattataaagatacctcaaaaggctgagccatccaggtcagaaattgaaaacaaagccaaatatttacccaaaatcaaacccagaacttctttcgaaattcactgaaagagcaatcatttccaatgtcttttcaccttctggtatgagatggaagtcaaactggaaatactgaaacactttaagaaaggcagtaaaacaaaaacaagccttcttgtaagacttccagatgaaagagttttgaataagcatttaatcatgtgtatcctggttcaagccaagctgaacctcaaaggtttacctgcgctcattatttagaattcacaatgaaatggaaacgcattacatctattgggaacattgacgatatgatgaaatgatttttgtaaggaaactgaatgtttacattaagcccatagccatggttcatctggcaatagggaaaaaaacacaatgctgcacttttgccaggctgtgtggagggagttttgttttcaacttcagtattcgcacaatctgagtctttttttatgcctgcatggaattttgagactaagtcaatgcacaaactaatttttctagcttgttttagatttctgtgattgtaatgtttctatgtaatgaaataccattttgttaaaaatgtttttggaaagatagttgtttacaatatgacaaggaatattaataaagttaaatattactaactataagttgctcctaaagcacatgcctaatgaaccacaatttaaatttaacatttaatttaattaagaatgccaatttccaaagaagtttttgaacttggagtattttagaactggtagagtgtctgactggctgccacattggcaaactggcctggtaaaatccatattttctactgtgttatgaaatacataactaataatcaaagagggaaaataaatcatgagttttctgcaagtggaattatctttcagaacaccagggtcaaatttcctgacattttgtcttaagaatcactggagattgtaaactgaataaattggcactaccaagaagtggacctaacataatttggcgtaattccagagctgattttatttcttcttcctttagaaggtgacagcgcctcttctccaagacaggatatccaagcacactgtatacatactctgaaaaaatgatgcttacaactgtcacatgaaagaatttacaaaattacatttccacactgttttggcttccttcatatcctgacaataaccagactatacgtttcacttgttctgcagccatatataaataatagaatgatataaagaataaaacaaactgctttccaaaaacagggcctgtaaatcacacagtgcagcaggttttgcttccaaaacatctaaactcttcctgggtgccagtaatatccaccacagaagcctcactgcattacctttgataaggactggttaatcttacagaagataattacagaaagaagaaaaaaaacagagaccctgggagtattagaaatctattatggatgaacataacatcacccaaaaaaggtctttttacaataagcaatagaaaaagtactctcttattgagaatgtaaacaatgaaggaagtgaaatcaatattgatagtctactgaccactggtgcactgagtcataattagtaactccatctagtataatttgaaggtcattagcaggatttagatagtgggattttttttaattaaactcttttctggaagtataacatacataaacaatgcaaattataaatacacagcacaataaatttttacagcataaatacacttaagtagcacattcaaatcaagaaataattacctgtaacttagatgacacccccatgagccctccaagtcacaacctcatcctcatcacaagataattagtagcttaacttcaaagagcctaaattgtctattctggaaacttttataagtgcaattatacaatatgcactcttttacctttgtcttcttttgctcaacattacatttgtgacatttgtctaggttggtgcatgtcaaagatcttcattctttttcattgttatataatattcaatatattgaatattatataatggataccacaatattatataatggataccacaacatattctactgctgtcaaacacatgggtaatttccagttttatactattgcaaacaatattgttctaaatacaattatgcttgtattttggtgcacatttttaagcatttctgttacaggtatacatacaagtagagtttttaggtcatgaaagatacatatcttcaactttaataaacaatactaaaaagtttttaaagttgtcacaacaaatgatactcccaccagcagtttgcttcacatctttactagtacttgaatttgtatttctcattttagcagttttaatgggtatatagtgttataccattgcgggttttttgcagtgattaaggaggttgtatagctcttcacaggtagattgtccatttgaatagcctcctttgtgacatatttgttctagtcttttcatagtttagttttgctgaaattatttcacttttctctcctttaaggtaaaaaatttatatctgtagaaccaactcagaagagtcctgtgccaaaccacataattgctcactcagtcctcacacctctatcggataggccccacttacccttcttcatctgtcggcgagaatactgagtctcagagagggtaaatcactaatccaaggtaacacagctcataatttccagagctagaatttaaacccaacgttttctttaagttgatcatctttccacttggaatattgaatctaggcaacgctgtcatgagcaaaggactaaccaatgatatatactaaagaatatttaaaagaaaaaaatgtgacaagtatatttgcatttattctcacaggtccttagtacaattaataaccctactaaggaaaggagacacattatacatgatagtaaggtttcagccaggcaactcataaaatcagagtagaattactacaatcaaaaccaaggggtccttagccatatctacttacactgttactaatcctttccacagacgtttgagtaattactgcatttgacatttctacatcactaagttaaagttagcaacacaaagcttcaacttcacattttacccgcatacttcttctgatgaattcaattgaatagaattaaattgttcatctaggtttcttgggtctcttcgtacatttcaaacacataagaccttctttcagtttagacaatatttaaattgagaaacagagaaaaggcagaaaggaaatctgtcatgtcatatgagtgggaacagttgacaggccagatatatgatggtctgttaagagattgcctagttatagaattttattatgcacattattgtaataattgtgctgtctactttgaacatgattcaaactggtctcccagcttactatcaagatagagcaaaacagttccatttgtggagccaacagagcattctgaattctgctgtatgcacagagacatggtcagtacccaagagacaaattgtcaaaattggaggccagaattttaagttgcttaatggcttttctggcttttaaaactatacacacattcatatggtaaacattctatgaggttcatactgtgtcgttgaaacattttactatttttttaatataaactaatccgaagctcacaatgaggaatgaattgccctgaacttggaaagatataatgacttctagtcctcatgagatttcacctctctcctgcctgcgcctttagccataaatgaggaggatagacactgtatctctagtatctctttcaatgaaaagccctatctcttccaatagatagtcctattgtttccaatttgggggaagcatgccagggtaaggacctggggagaaaaaagtcctgaacatgaaacggcaagtgtaatgaaggggggtgatttgctagttttgctttttagtcatgtgtatctggatatacaatcctcagtctgcctctttctagccgggtgattatggacaattaaccattcaaggatctctttcaatgtaagagtaatctttggagagttgcaggaaattgtcgggagagaaataagatatattcaaatggaaggggaaaagagaaagcctcttgcttaataaatcttcccaaatttccccaggtagcagctattgacaaaccaggacacacagataatgaaataatattggatcatatgtataaagtggttgccatgtgttaagtgcattacacattgaaggagtttacacacacaaacacacacacatgaatatgcagtatgccacctggtctcctaacttcctgccctgtttagagatatttaaagtccaagcttctttatagtttgatcctccattacaatttttagcaatatatatctgcttccacatatgatgcttgctcttttaagctatgctttatgttccccacaataacatttttttcttgtgaaatctctggtgcagtcttaagcaaataatattcatcagtttcctcatctttaaaatgcaaatgataataatcccttcttcacagcgttgctgcaagagttaaatgagctaatttttctaaaattcttagaacaatgcctagcacataataagaacaatgtaaatatttgtgaaacaaaataaatctattttgttttgtaatttagtttttatatttggatttcttttcttaacaatgttttcttaggagaaaatactatgccatagatatttgtgtttcattcaggaaagcaggctagaaggaagaaaagaaatgatcttttattgaatagttccaataatctgagcactgtactgatgtttttaaaataaattttgccatctaatcttccaaagactatatgagttgggtatgattatccctgggtattacttctcacttcaaaaatgagaaaataagatcaaatataagtttcttgacaaccaggcatagcagtggctgaaaaaataattttaaaagattttgccttttacatgcttttggtcattaccaaatctggctttgcgtaatttctacatctgaaatgtactaaaactaagtaacagcactgatagctgtggcaccctcaacttagtgcatagcatccatctgtctatctacctatctacctacctatgtcctttctttctaaggacgccttcttatcataagtgtcagactttgtgttatgctgagtgtgaacccactggcacttgttagctatagggatctaaagtagcatttttgaaactgggaatccaactggatatatcatagatgttctccaaaactcagttctgaggtcaaaaaatatttgataaatgcgagattagacaatgttaaattggttgcttgctgcataacttctcagaaatttgaatattctaatattgtcatatatttccttgaggattagagggtatgctacagtgccaagtttattttactacaggattttttttaattttacccattaacatctcacaagttaatggcattcaatagaccatggtttagaaaattctgccttttccaaaaaaagaccagacacaatgaggaagcacataaaagttgagaacaagttaacacaaatatcaaactctcaagaagaatctagacaccaaagaacagcattttaatagagacacttacaatgtagctttcacaagccagtagctagacccacaccgcatagaaactcaatggatatatattaaatgatgaatgaatacaagccagttattctgtttaaagaaaatgcattgctctattctttttctcatcctatgtggaatcaaaattacagaaaggaaggaggaagaagtgacaaaagacatcaaaatgttagtgtctctattaatattgttacttaggcaaaaaaatttaaaaggttgtttacccagagtaagaggaaggaggattgtgtggctaaggggacactggtgcaaaaccaagagcagtcccttgagaagaaagatcacacatgcatgtgcacacacacacacacaatccctggcatccttcaaacaaattttctcactctcccaaggcaaacatttgagtattttcactatccatttctatgaaacagaaatctctggaagcaagagaacatacatcacatgaggagcttttgatatgattttgaattatccaaccacaaatatctcaagtttgtgttggaccacaaggttggtagaagagaaaggcaaatgggaaaaaacaattgataatttggctcatgaataattgttttctaatacacctctgtttcttcatttctccacaaatcttttcttctctgcctcctactctgtttttctccatgatctgttctggttatttcttaacttggtctgcgttttcttactaagatgcccttaaaagtagggttagaggtttttaaaagagaagagaaagaaagaaatcagaaaagcagggaaattaatcagagatatttccagtaaaagagcttttcagatgaacattagaagcgaaaaatggtatgtggcataaagttacaccagcaatattcttaagtcatggaacattttaaactagcagctgtaaatgctgtcttcttcctaatttaatagggccctacatctagatgtggcccagaatagacttggtggagtacaccaattaaaactaattcatttgttcatattccttatgcaggttttccctttttgcttcatatacagcaagaacccactattccactagtttatttttgaaataaactccttgtgctttttcaagcaaagtgccggcactggttacaaccattacagaaagagaagaggttatacagaaagagaagaggttaacagagagtgagaatccgagtgtaaagcgcatgggcagaatataaagaatttccaaactgccttgagccgctccatatgttcctggtgctcagtggcagccctcaataggagcaccatatcttttagtcccatgtataaatttgttctgtaaattaaaatgttggcttgtgctcccctggtgtttaagaaggtgagtgatgaccttggtgggagtacgtttgtgtagaaatgtgtcataaaagatgatgtcttggcccaagcaatgcagggtccaggtttagtcatttgttaaaaaaaaaaaaaaaaagagttaaatataactaacacatcatgggagtgaggctcttgccaaatgtaactttcttttgaaatctgagatgtcagctttcgccctgtgctttttaaaaaatatttttagcattttcttttacagagtttccttgctttggtcatttttttaagttgcaaacaaagcaataagtagtatacatttttcactaattaaaatactgtcaattgattctttctctcttgcacatttattggacaatgatggacttagttcaacatggcatttattttctgaaatgactaacaaatagcaggttttatgtattcatttatactaccattttgatttgaatattaaaatattgttcatagatttgagtgaggaatttttttaaccattcttcttcctatcttctgtgtcactgtttttttattttgcacgttaagtgaaataaataaatttacgccattcattcacagagctctttggcaaatcacattttggaggatgcctcaaagacaaatatcaatgactggcttcctccaactacattgctcctcagaaaatgggttccatgatgttctgatactctcatgctagtttatctattttttaagacaaaaacaaaagctatatttcagattgacaaatactgtcacttcagggtgattcatttaacatatgttaggatgtcacataggctgatactgtgctatttcagaagcagctggactacagaagcatgcgataaatgtagattttataaatctaaaataaaaggtacttaaaacaattattgaaagtattatgtgtacctgagatctataatataagttttccaaactttcacggaaggtgctatcaatggctaaatatctccagggaatgcctaaattgataaggattgcacagggaaggagatgaaatattattattttctatagggaaactggaaaaatactattaagttgtttgctaagtgccaatcagtctgtgtttgtaaagactaaaattcctcatgatttgagcaatgcatgctaacgttataactgtatctcattttagtccagtggaaaatgaactataatgcaaaactcaaacaagtatgttctgctcagataaaaatttatggttcatgtatccaaagtgatatctggaaagttcacttgttcaaaatccaacaagcttgtttcaaactttagtgaccatataaacactgcctttcttctctgggctattctttatctagtaagtggggatgcttttgattaacatttaaatagtatattttaaatttattttgttgattgttcctgataatacactgaggaatcatctgctttatttgacaataaatgcagctgtaaactatagccatcaagagtcataatctgaatgacatgtcatgctttcttggccacaaacctttcttttaattattttttatttaatagcgaacttacatcaaaataaatctgagccatcacttctgttaagggcctctctggggggccatcatttttttttcttttttataatataaacttttggtaaaatttacttgtttttaaactctcttgaaacttcatccaatggtcaaatgtaagatcttagaggtggaaacaagagacctattcctcaagtcctagagcaggcctagatgtgagtgacagaaatctctccatgcccactagacaacaaacacttaaccactcattgcaactatttttcaaaagcacctctccagttgtacattatggaaatcagctccaccaaaatcgcctgtacttgctgcttagggatggtttagataccacagatcctgcaggcagtctctgaacccaaaatgtaagcaacatttgcaatgacagagaaagaaaatctcttggagggatacaaaggcaaacaaaacaactgcttttcattaccagacagatgaacaaattagaattccattaatgaatagtttgttagttttttctctctctggacgggaaaaaaaaactaaaatttaaagcctatgaaagtcattttcttataataactaattttaatggaatattatcagtttgttacagaataaactggaaaggtgggtgtgaaggacagggcctttataacattaaaagacaatataaaaaagataaagtgaacccaaaaaatggtaggatgaaaagcaagtgaaaagtaaatctgtgttcaaccaggacatatgttagattttactcttttattttaattctatttatacttcaaattacatgtcggaatgtttttctactataaatatttccagtgtgtaacagcagaacattcctagtaaaacaaaaggagaaaccatgacaaaaatctgagtgacagctttctctcacttccaaatactgatacaatgatgggtaaggtaaagcaaaggatcaaaaggcataaaagttgaaatattttcctttctcgcccatttcctccctcaccgtgcaacctccatctatcctacttttattgtctttgaaagtgaagctcattttttaaaccttcttgaatacttttggatcagggttcattacactggcaacagcccacttactgctttcaatagaaactttgcaaacaagctctgtgacatttttgcattttgtttgaaggctaaactggtccctcaatgcactcaatatttctttcctgaacaagaggtgaaagatagaaattgagcttggccatccattgaacatgtcagactttttcctcagttttgctaaaacacccgtttttctccctttagaaagatacaaatgaccattggttatgaggtagaggaacaggcacttaatgtcagataactgaaagttctacagtgcaattcttttaactgcactagcttgtgataaccaataggatttgggcaggagtggggtgggctactgggatgaaactggaagaagaaaaattatacaaaaaagtaaaatacatgcatggaagaatagagagtgaaattaaaagtcatttaaatgaatataaaaaaatataaatacatagctgagatacatttagttcctcattttaccacatttctcatcttttgaaaatgtgatttttcatttctttaatgtgggatgccagggttgttgtaaataaaatacaaaacaaaatttaaaatatttaaagtaataatataggaagaggcataatgggaaagggaattactgatttctcccacggcaaaaaaaaaaaaaacttgaaaacaattaatgtgaaaaaaaataaacaaagatcaagatacattgagaagcagcacagagctgtcacctctgtggcactcacatctgcttcttttccacagtctaacaaccagccaggtgagagacgctcaagaaagccgctgcaggacacaagcatcccaaaggtgacacaggtttcctactgataaaatagctgccgtctttttctatttctcaggaaagatgtatcatccatggataatatgttttcaattttaaattttactcatataaatttttctttaacctatggaacgtgcaactgcctagctgccagcaactgctagcaaaggacagaataaataaccagcaggaagacattaacttaaaaacttagcacaagaatatttgttaccatggactcataagttcaaggctatagatgtaaaactcatatatagtcagacttctgctgtgataaaaatgttcctacttcatatgatgtaatattttctggtgtgctataaagggcatcagaactttgggatagattttcacctcaataagttggagaagcactagcatgaggattaatttaattaattttattaaaggcactatttttttaaatgttaccttcctgtccaattgataacaatgatagaagaggataccttaaccaaggaataattaggaacatgggacaaagacccagtgttctttgactggttaataatttgtactttccttggtcaaaatcaagaggggcttgatagaaagttctctgagtatttcaacaggaaaaaagctgaagtttgacttagcttaaattagttatcaccctcaatatcataaacttctaccatttggatcattcctttggtttacggtaccacagtcctcatgaaaatgatcacgtttatcaaaatacttttttgcttgaggagcaatccatagtaggcatttaatatagaaaaactttggtagtgtaaaggattaaggaaaggtcagacagattgctgcttgacaaaacttgtgcccagaatgtcatataaatgtgcacatagtaactgcacaataaatgttgacccacggaagtggcaagcttagaaacaaggcaagtgctgaaggtgaaaatgaaatgctaaaatgggcatagccatgcccaaaccacactcctcaaaaccagccctcaagctccagtttcctcttttgattttcttatccataatcagtatttttcagcctgatgaacaattcagaagagacagtttgaagagttcaagattttaataagtcagaatctccaaaatcttgttttcttttctgctcttaatgcaggaaaatttgcttctgctctgtgagtaggaaaaatgagcacatggagagagagagtgtggcctgaatggtaatccctagcctaaagcttcacaaagaaaaactgaaaaggcttttatgaagagaattcagcctttacgtgcatgacttgaagcaatctcttgaactaggttctgaagttcagaaaacaaattctatataatcaaaacagagggcagagttatgtgtggatgtcttggctctcctaaaattttgagcatttcctgtaggaagtctctaagaataatgtggctcagccccagatagaggagcaacaagaggacaccagggtgctgccaatcctacttgtccatccttctggttttacagcaaacctagcaggaagcagcaattggagcctgggaataatgggtgagggcgttgatctttggccactgaagacagcctgcttaaaattggagaaaacaaaaacaaaaacaaaaacagaagaaaaaaaaaccccactgcacttcttccaacatgtagtttcaaaatgtaaaagaataaaaattaagcttctttcccttggaatcttgagtttatcttttcatcaggaagatataaattgtaacctcctctctttgcttaacaaacagctaactataatacagagggtttccctccttagaggtaatatgatatttccccccctttctcactgtcatttatacatagtggaagtgtcttaaagaataagcatgatcatgtaagatatacattgtggtttgtaaaatattcaagtttttttacttagtcacctctatgccagcttttaaatatgactgaaatatgttcataagattatttaaacttttgtcctaaagttttgttctccttattaatttatcacatgtgtcctatgtaatatgatcatctgtatatggtatgtaaaaaatatatatatgtttagctcctacaaaggtttttctcagataaatccaactacgaataagtagacacaccccatccacattcagaaagtgatttaaagcccaggagaccccatgatgtggccatactttgaaacaggggagctacattcaatttttaagaaacctaatgaaaaaattataaagtcatgaaaaaagttataagcacaaatatcagggtttgagaatggcagttgtataaggtcactctggaaaaattaatattttgtctaaaataaagtcctatattatttaaatagttataaatatgtttataagccaaattaatttcaaaatgctacatttatagatatatgataagcaaatgagtaatgaaaatatattaatatattaattatattaattaaatatattatttaaaatatatatttcatacataaattaaatatagtacaatatttatatgtactacaattatatatctacatataataattatgttatgcatattacattgcatatattttatatgtaaatgacatatatttattctttttaaccatatagcttaaacttttctatttcaacaaagaaagcaaaatacgtattttatttctaggattccattcagaagacatgtgatacacctcgaaactgaatttttatttgtttattaaaagcctgacacatggattttgatattttttatgtccctaccctgtgctaatgtgataaatataatttcctttttcaaactactcatatcttaaatgctcttttactacatgtttggcctcaaattcctttttgaataaggtggagtactataaacaaacaatatttaatggctgttttgctgaataaaaatataacagttaacagctttcttcattaacatgctcgcccaggagctggtttaactttccatagcaagacgtggtcatcaaaattcctattccatatttccaaatgctttttctgtcatattatttactggaatttagattattataagcatacgttctatgaggaaattttttaaactgataacaccataaaaactacatcacctgggagactgaagctctggtttagatgagaaaattcttttcagatccacagtttcgatttgcagcagggatgactcagcctccgatagcacactgtgtatccaatgcctagtgattcagcttgggacagttgggattatagaagaaggaacagattttcttataaaaacaagtggtttttttccttcttcatgccttacaatctgttcaagaaacaaatatcattcttatcttacccttaagacaaaatttttgtcagccacaaaaaatcaagtaaatattaaccttagaatatctggagtacagttcatctagagaaaatgatagattcattctggacaagtaggaaataaaagaatagtaatacatattttctattgtgtacttccagagataaagttgattgatttttttcccaattttttattttgaaagatgtgaagaattatataatgaacaccaacatatcttagggtcatcctttttttaacaacttgcttcatttgcttttttctttcttcatctctatgtatattttttgtgcttattcacttgaaagttagttgcagtcaacataacattttagccccaaatactttagcatatatcaccttaagaacaagaatattctcctataaaaccataatataacatacccaagaaacatattatctagtagacagttgttcctcaatgctttattgtttctgatccaggatccaataaaaaattacacagtgaatttggttgtctctttcgactcctttaatctggaatgagtttttaatttgatacagtgaaaatgcttattttcaaaattactcagtctctagagtatcatcaattaatactgtcagcaaataatcaggaagacaatcttagaaacctggccagataccaaacttaaaaaaaaaatctataatcatttcactggaaaaaaaattccttcccaattcaacccatgtaaacctcggccaggtaaagaacaagagaagcaaacttgaaagtaaccaggggcttaaaccatacaaaccccatacatcaagttcagcagtttgaattgaattggtggtcagcctactttgtgtagtacaacaaggtaaatgtgctggcaatacagtagagccagccgacaaaataaatgttcattttgactgatacttcactattcaaatactctgcccttctttccccctgaaaccctcaatgccattttatataaaaatttaaacatattctgacagtggttttatggataatactaatgaatactatcatattaaatttctgttcgttctctgaatacttctcttcctcccagtttacattattttgggaaaagcacatctttaatctttattggcaataagctcgcctcttgttattcactttaggagaaaatccttattagaaatgcagtgctaaaaaggtacctaagtcatcaatattatggtatttcatgaattgaatttgatgtatcatacacagatgcttgcattaaagcatacaacttattttggttcaataaaatgttaatacattgtttagcatttataaacaaacgtaccatcttcagtgctaaatacgcaaatgacaaatgtaacaaacatgatgaacttattttccaaatcctgcatcataggcacatgaaatactttggttcacctgaaacataatctttcatcataagaaagggaatattatgatgagagaggagtgatagaaatgtggctgttttcctgtttttgatttttatgtgaaacttaaaagtcaataagagagagtggatttcaaatgcaaggtaatggacaaaggcagcaaaggggggtttctattgccacctagtgtctaactttataagggacttatttttgaacatgacagcagtcacacaatgtgaaacagactctgaaacgggaaaggtaattacggcactttccagccaaagaatttcagtctttttttcttatggtcaacctcctgtcactgtataactggtctatatatataaaaataccaaaaatttcacatattaaagagtgatatttatgaagatggtgatttgtgtatatatcatgatatatacatgtacatttgaaattaattccattattattttggatcagtataactatttagaaagtataattcctgatgaaacaagaaatagttatctgtcacacttactccattgatatttacttaaaatattactacgaaattttttcacttttttttttactttatgtaaagcaatctatttagtttggctaacacattttatgtcctcaaggcttttgccaccttataattagactctaattttagaaattgaattggttattgtgtcactgtataaactacttaatctccctccccgcaaaaatgtccagcagttcactgaaataagaaatcaatggagcagatttaactagcttcaactgtgcaatgaaaatatgctagtgaaaagttactggagatatgccccaacataactgtaatctaatgatccaaatcaatacatatttgaatagtcagttatttttcatccttttcatgttgtgagcataatgcagtcatgtagattatgctgtctgaggagtggtttagattgttttattggtctgcaacatgattgccaaagtacaactcctttcttttataaatagatatctgcggttggcgtagagatgtcatcttctcctataacagcctgataaagatcaggttttagtatttaaggttttgttttaaagtcaagttgaagtttttaggcattaattttatctggcatgaggcgagctggagtggtgtatgcaagtgataaccactctttctttgaaaataaactgcacagtttgactttggcagggtttcaacggtggaagacttatctgcttgtaaagttctccctcacgtacgtgcttactccatttatttttttacttagtgtaatgaggtctgtggaatggaaaaaaatagcaacaggagagttggagactattttatagagcgaaatacatatgtgtatgaataatgttaactctgtgaatgagtaaattctctttagttttttcaatcaatcatgcaaagcgagaatcagagcctttaaaaatacaaaagatggtatttattttcttgagactaacttgcaatcatataagccacatattttatcattttgtatctttacatggagtgcctattcttgagggtgtattcacaaactcatatttgagtcattgcttctttggccatgtacgtccatattgcaaaggcactgattaaaatatgacaataaaatggactaggtgactttttaataagtgcatgtaaatagtagcagaaaaatgaaaaaaaaagtgttactgaaagatgaaactgaagaaaatttgacccatgctaattcttcactcaaaaaggggaaaagaaaatatctacaaatatgttcttaaaggcaggaataaaacattgcagctaggatttcctggtaataattaagcttcataattatacctaaaaattgtatcatctcagttctatttagtaacaaagcaattcttttccaagtttttttcatcaagcaccccaccacacacagatccctgcagtcactaactcaccaacatcacccatatgtccccagtctcccaaaccatatagaaagctattttcctttcatcacctctctcaaagtcagcagttttaggcttgaaaatccatacaagggacaagctctgtcttagttagagttcttaaattaccctagacttgggaggcttaaacaagagaaattcattttctcacagttctggaggctggaagtctgagaccaggttaccagcatgactgggttgtggtgagggccctcatgcaggttgtggatggtcatatttcttgctgtatcttcacagggtagaaagagagtgagagagctctcgggtctcttttataaaggcactaccattcatgacggatccactctcatgacctaatgacctcccaaagtccccacctcctaataccagcacattgggagttaggatttcaacactcgaattgggggcagggggcactaatgttaagttcattgcaggctgctggacagagactttccaggcaaaatagaccacgattagggacacaagtgaccatggaaggctgcacgcttctttatgactgtggctattctagtcagagaaggggacagagacttaaagagtatttggaaccaggtgaaaaggttcatgcccaaattttatggtgtccagccatgtgtcatgatagcaacaaaattctcgatatttctatgagcaatatcagtcggtctcttttccacattgttaggagatcccaacgggccacagctatggaaaagcagggagaagggaggtccagcaatggtaattcatgtttgtttcccttaattaggtggtggctttatatcccagtgtcctgtattttaagggacatatgttgggacttaattaatactgaggaggaaaacaatttttcaaatcctttgtgtacaaagagaaatcaagcaactttggcaagcttcagtaactatttctggagaccagagtattagcaagtttataaaatattgtgtgccagtaggttcaaaagtattattaaaattctctgaattattgaattttgacaaattccatgtgtgaaaatatatcaaaaggtacatataaggaaggtctcatgtcctaaagttggagaaaccggacaaatgaaaactttataaaagcagaaataatgcaggattaaatgccaattcactaaaacagaccatctacactgacagagttcagaaggaggagaaacggtggcgggaatagcagtatggatggaaaggagtcagcatccaggctgaccttgaagagacattgggacatacaccagtgggtgtcagtaggaaagtcaggacaggcaggggagcagcaggcacagaggatggggttcagagatggccttgattccagaactgaccaactacacccacctgttccaaaaataaacacctagtgtgttctttctgtctgagagacactgtgggaagaggtgtgagggaagaaaatgtttgagaaggagaattcatgcttatggctctcttcaaagcaccagaccccatgctaatcactttacccttgagttcctactccagaagtctgtagtgaaacaaacacaaagcataccaataactacagcactgggtaaaggaggagagttgctgtatgagagtcataatgttagaaaactccaagcacagagatgctcctcaagctaggagaaataaggaaaactcaacagaggaggaggcacgattgtcaggactgaaactcgtgtgggattgaagacggagtgatgtccccaaagagagagatgtcccaaaagagagagatagagccagactcaatgggctttaaatataatagaatgggcttaaatgattttctgtgttcagtgaggggcattagagatgtaaagcagtagagcagaggtatggaagttacgttttctggatggtaattgggtgctgaggagcagaataaatctgttggagagccttccttcaggcaaacgaggtgtattattctgttctcatgctgctaataaagacatacttgagactgggtaattttaaaggaaagaggtttaatggactcacagttccacatggctggggaggcctcataatcatggcagaaggcaaaggagaagcaaagtcacaccttacatggtggcagacgagagagcttgtgcaggggaactcacatctataaaaccattaggtttcgtgagacttattcactaccatgagaacagtatggaggaaaccacccccacgattcaattatctccacctggccctgcctttgacatgtggggattattataattcaaggtgggatttgggtgggcacacagccaaaccatatcaccaggaaagaaatctactggagtgaaaggaaagatctggccctgggtagtggcctaggaaagagctcctgcaatgtgatattaaaaaagcagaattttgggcttgagtttcatataagggtcactaactagattgtaaatttgggcaactctttcttcctcttcaacatttaatcttttcatttgtaaagagagaaatgaaggacacttaagtagtgaattcttcgggagattgataaattacatgtgagtagtctctctgccttttatttgtctctagtgtttttgatatgagaaggtccactaatataaatagttctctttttaattaggttgatgaaaaatatgtgtacagatataatctactaatcaatctttaaattattgaactttattaatagttggataatctgagtgcagctatcacaaaagcctaaagctcaaaagacctggaagatcatctggtttaattccagttgtagattcagatactaaagccgttggagggtcagttactaatcaaagtcacataaatgcaaatagccaatgaaaaaacttaattcaaagtcctctgattggtgagccaaatatatttttccctgggcaggctgtctctgcataatatgttttatttttttttccatgtttcagaaggtaggtgatatgcatagtatttttcaatgaaatggatgcattacataccaccaggcaaggagttctgacttgactctgccatgttagcaaatctgcttgtatgctaccctaggaagacagcagagtatccgaggatttggaaatgcagttgattggattaataccctggctctgctacttacgaccttaagcaggttattaaaactccgttaaactaaatttactcattgataaatggtgaaaataatgttgagcttccaaagttgttgtagaatcaaaagagaaaatgtaggtaggttacctagggcctcatctgatagcttattgctgtttatcaggttttcttcctttctgtgtcatttcctgaggaaggctggtattcatttagttctcttccaaaactatgacatttgagggtatgactctagtaaatgcttactattgaatgaatggctcttcctgaacatgctatgctttactacagcacttttcacagcagtgtcattcatcaacttgcagaaaaaataaatgactaagtgaatagataaataaatgaataaaatagatgagtgactagaacttagcccaagactgtaaaatttcttgtgtttgtgaaagtctcacagaccttctccagaatatggaggtaaaacctagaggggctcaagtcttgtcagatcctagggactcctcaggttacataaatagcttcatgtggtctcaaaattctaagcaagtatttgtaaagctgtgtgcatgcgaatattttaaaggtaaagattcatagctctcattagattttcaaaagagtttgtaatacccaaaatattaagaactactaccataggcctggcccaagactctattctacatacatttcaatctatgtagttctgccaggcaatatatggccctcccagcaaatagcaccacagtattacacttcaatggaagccatgttttattcgtcaataccatctcacaacaattcacaattatccacataaatagcttacagatcaggaactgtttgggaaaaccattctgatgtttttaaagagctgtagttacatactaaacatatgtaatacagaaagtggtctcagggaaagagtgagaaagctgtaaattcaaagtatatgttaaaactcaatgtgaatatgtagttaaaattcaattaaacttaaaatgcatatataatttgaaagaaagctaaataatgagtgtaatttataaatacatgataattatcctatgagttgtgaaataatggtacttggtaaatatgagtaacaacgaatgtcaacaaatatttataaaatttctatggtgattgaagctccctatataaaataatttgcatttaacaaattttctgacccagcaagttgtagcatatattatattccattgaaggaagaagtttccattttagcaataagatttttttcatcaattagaagttgcatctttccatataaatgtgaaatataatcctaattttcttcattagcaactcctaacatgctaattttcttaatgtatgtattcagtatctgaacagtgatttttaaacctgaaaatgttttattattgtgagtttttaaataaataaaatgcgattgatattgcaagcaggcttgtcatgcctgaacgcagcaccatactgttttacagaataaagaagatcttgaaccatagaaatgttttgctgttgaaggatactactgttgattctaaggaccctctatgaaatggaaggatctttagagggtcttccattcctccttttttcagtaagggcaccccaatcttccttgggaaagcatggctattctactgtcaatctatgtagttctgcttagcatggttgcacatgcttgtagccccagcgacttgagaggccaaggtaggaggatcactagaccccaggagtttgaagccagcctgggaaacagggggagaaccccatctagaaaaaaacacaaaacctatgtagttctggtgaagctgattctaccccttacttcaggagtgaatatttgacccagtcctggtgaatcagagcatcacaaagtccctgtgagttagatttctgccatttgcaagcaaaagagcaaacctgctacactggcctatgttcatttttcttctgggatcattttgccacttccattctgacattactagtcctcctattactgtaggaggtgctgggttggtgccgcatgtcatgtacatttcaagatgggccactgcctttattatttggtaagaaaacatacattctaatttttataatatttatatagtgctttatggtttacaaggcctttcacattagaaacccctgtcttgtacccttttgctttctcctaccaaacttttcttataaccaactcacaattattggaaacagtttaagaaacgtgaatctcagaggaacatggtcatcatggattaaaaacagaagaatggtcaatatatttaatatttattgactgcccactaacaccaaattctttaagtttgtggttctcatttatactgctagcatttgttcaaagtcaatgttatcgatctatctggagacacagtttaaagatattacataactcaaccaagatcacaaagtaactcaaccaagattgttaagtggtagagttgtgataaaaactcagttctacctgagtccagaaacagattgtttaaccaatatgttcaactgctggctcagtcacaaaagcaaaaacaaacaaataagaaacacatcatgctcatggaactccttaaagaaacaccaatggtagtaatgtacttttcaaactggatgaatacatatgttatcacaacagatatgtttaattaatactgactttatcccttccagtttctgatccaacaactcagatttggggaaccaagaactgaaaataagaaaagccttgctccatgatttcagtcttaaaaaaaactcagctgtagaaaaggtccactttgagaaacgtaatctataatcaaatggataaaggcataagagtgaaaaatgaagttgttaagctgaagtgatgagaactgaaaagggtcagagatgcatggaaattgaaatgaactagatctgtctgttaggatgctgtttttgtatactacaggcagcagattttgagtcaaaggtgaaccatggattccgtacagactactcaggctcacatgtggaaatgaaatctcaaggaacaagacacacacacacacaaaaacctgctttaatagatttgtggggatgttggccagtcactctaaccatagagaaaaaaagactttaggaactgcgtctctggcacatgcttcaggattccttctagagatcaggaggttactctgttggtaggaagaacaccagaaaggcatcatcttgccaggaagaccttgctactcttttgctgtaagcagtttattccttgatccacaagagaccacaattattcttaacttttaaaacataaactttgagttaaaggaaaactggttgaaaatatccaatttgaattttatagcttcagaaagttggatcataattgctctctgaaaagagagctcatcaattcaccctccctgtaggagatagtcagtgtctgatccattaagttatcatcctaaagcaggacatttatcataatttattctaggatattctaaatttgctctgttgattaccattgtgtaaacaatgtcttctgcgagcttgggttgcatgattgagcgttggaactggcactgatttgaagttaccatttgctaaagagcttctggttgttctatcagtacaaactccagggatgtctaacaagggacatagtggttatgaaaaaaaaatgaggctcttcctctatgtaatgttaatgggccacttactgaactatatctctttggagaggcaagtctaaatggtatgaggttaaagaacattagaaagtggtttgtgcatgttcaacaacatgacttttctcattaaaaaaagaaaaaaaaatcctgcacctaagatatttgtagaagtcagcattaaaaaggtttttttaaataaatatcttaaatgacaatgtacagagcaaagtaatggcaagttttctcataactatagtagaagctgtccaaactggaaggaaggacttattttttaatttgctatatttttcttaaggaaaaatatatattcaaaaatgtatttgacattggctgaagacactgagtatttattaaaattagtgacatctggctctttctttccttcagacattgctcataactcttctaccctttttctccccaatatttctcttgcttcatttccaaccgtatgataattattcaagttattcccaatccttcagcctttggcattgaaagggacttgactttctccatccaatgttacctttatgtttttgtccttctctatctttcagaatggagaaaactgatgtaaaatcttatctgagggccgggcgcggtggctcacgcctgtaatcccagtacttcgggaggccaaggcgggcagatcacagtcaggagttcaagaccaccctgaccaacatggtgaaaccccgtctctactgaaaatacaaaaattagctgggcatgcacctgtaatcccagctacccaggaggctgaggcaggagaatctcttgaacctgggagatggaggctgcagtgagcagagatcgtgccactgcactccatcctgggcgacacagcgagactccatctcaaaaaaaaaaaaaatcttatttgaatatttttgtctctgctgcaaaagattctttcttccctttgttccttgactttctcctaagaaatattttattatttttttcatacagatatttgtgtcagactaatgcctaatatactgagcttctttccagatgataccaatagaaagttggaagaaattatcacaaaagaaaggaagtttatctaatattttttcggcacagctttctgtctctttggcttagctcgaatcaaattcagcctttagtctgatgtctcttttaatgctatcttatttctttttttcagcagcatggttgcctcattgaatgtattttcaactcaattgattgcagttatctctgagtgatactatagctgttctggataatccatgaaattctaagtgtcttatttacaacctcattctttggataatgctcacataaagatgtcattcctcgtgctgtattaactgttaccatgttaatctgacaaaggactggctgatctaaaacatagccctgaagaggctgaacatagaaagtttaccgatcaaaatggtgtcctcatgaagtgctctgcccactttgatagaacaagctaaccccatcatattactttatggcatctagatatttcatttccatcagaccttgcccataattcttccacacttttctcctcaatttttcttttgctacctcatcaaccacatattcatggtaacctagttattttcagtatcttcaagctttggtttgatgaggacttgattttcaccacatgattttacctttcaatgtgttcttttccattaaagttttttctccacctttgccttttcaaagtgaagtataatgtaaaatcatatttgaatattttttctgtgctttgaaagttacttgcttccctttttctcttttctttccctttgaaagtcctttgtcatggtggagtataaacataagattcacacaggagcctaaaaggacagtaatagaaagctacagaaagacaaaatgtctgggtcactagagcttctagtgaatgcaaaattaggattattccaattttccacaaggcctagggcttagactcactctacagcttctgagatgttgccatcgttccatgctctccaagtatcttcactaaaaatttacatttctttgaaattttaaaaaacctcatgctcaccttttcatctcaatgaaaaatttgtccttgagtaagtttatcttcttccctccttctgacctcaatccagttccaccctattacaagatgatactcgagttctgtttcagaggagaaggttgaatccatgtggcctaaagtatacttctggaaagagcttcatacttgccttctataaaatcagcaagcacaaaatgctcaaattgagtgagggttaattgtaaatttacctccttaaccgtatataagaataattactagctaaataccttatagaaattaagaaaataatatatttttgtgagatatcattagacacaatttatcaaaagagctggagtcagaaaggggtaaacagaaaacagaacactactttattctttcttcaaactttcccattcaacccaccctattctaacctattgtatgaaattctttagtcattttcagtgattgaaaagtcaagccattctacaaggcaatttgcctgttctcttcaaaaactcaatatcatgattagtaacttgaataatgtacttagtagaagaaacacgactaacagagattttgaactcctaatgtttaataatttaaaatattgaaatgtgtatatggcatttataaatatttctcattaaataaacgtctaatggaaatatataggaatataatacacaaatgtttcaaaccctactatttgcaacaaagtgggaaactataatactaataatactttcaatttttagccagttggcagaattggcaattctggtactgttaactctttatatagtaaaacattggatctattggaaccctgcaaagtcattattgtcactattttagagacagagaaactaatacccagagaagataagtaactatccccaaaacaatacaagatatgtaatgacctcaagctcttaaacaggtgagcaaatagaccaaagctagcaaaagttgtgaaggagaatgactatatttactattttctgatgtttttccatatgctatggcatatatgtggaaactgacaaatgtcatcaacagtgggccactcagccccttccaactgcagaacaaaaaaaaaagttattattgtacaatctttaaaatcatccaggatttgcacactttgatagaagtacgcaaatataaaattaataaaatttgaataagcaaaatgaccacaaatattagaatacttatctgtctgaagaatttttgtaatggtagaaatcaatctcacttgtgtcttttttgggggtattctgtttgtttttcggttttggcttgttggtaggatacagagttctattttaatgacagtatactcattttcaccggtgtaaatacaaacacggttcaatttagagatggcaaccttgaaatgagagatgttgtcttaaatgtgaactctgacaggtaagaatagagcaaattcattttgacctccaaaatcatgggagactgttctatattttaaaagacagagacatacaatgtataattaaaatataaaaataaaaacaactatacaaaatattttggggggggatggggaaatttaaacataaatttggggaagaagatgccaggaatatgcagtatctttgtaattgaagtagtagagactagatctcagcagcctgggagatagtccttccagagctgaagtccctcacgaggtctctgtgggttaacatcagcaagggtcccaactgatactcactgatactcaaagggcgcgcctgctctctctctctttttttttttctgatggagcctaacactgttgcccaggctggagtgcagtggtgcaatcttggctcactgcaacctctgcctcccaggttcaagtgattctcctgcctcagcctccccagtagctgggactgcaagtgtgcaccatcacactcagctgatttttgtatttttagtagagacggggttttgccacgttggccaggctggtctcgaactcctgacctcaagtgacccacctgcctcagcgtcccaaagggctgggattacaggtgtgagctactgtgccccggccagggtgcacctgttcttgagaggacagaaggcatcaaatcagaccccagtcagtttcaccagcctcactcagcctgtaaacgcaatacagaagaatctacttgtgatcctctctactataggacactgaaaattgccacaatctaacaatccagcagattacaccactagtgagtggcagtggcaaaatgtgaatcctggttgcctgactgcaggtttataactagatacataatagctcagaaatagaaccacatatccatggaggcattgcttacgacatgtggctttggcataacaaatcattaaagcaaagatgcagattacatcatttttgatagtaaaaatatacattactttattgaaaaaataaaaataacactatctcactccatacacaaaaataaattctagattttgactatataaatataaaaaattaaagctcaaaattctagaagatattataagatttatgacacatctagacaggagataatttcttaaggcacaaaaaagagaaagattgatttgtttaaactttcatgttaaaaagccttgaaatccacagacttcataacgtattttcctaaccaactgcctacaatcaagatttttaatttttccaaagtcattccaatagtatacatatcattccaagataatgcctactaaaattacagtgttttagtttctgataaagtttttcatttaataaagccaaatacctggacgagcgcagtggctcacacctgtaatcccagcactttgagaggccaaggcgggcagatcatctgaggtcaggagttcaagaccagcctgaccaacatggtgaaaccctgtctctactaaaaagacaaaaaagtagccaggcgtggtggcgcatgcctgtaatcccagctactcaggaggctgagacaggagaatcacttgaaccaaggtgatggaggttgcagtgagccgaattcacaccatcgcactccagcctaggcatcgcgccactgcactccagcctaggcaacaagagtggaactctgtctcaaaaaaaaaaaaaagaggaaagcaatcaaacgcctatacagggagtatgcaataatgttctttcacagagtgtccatttgttgtgaaacactgaagatcaacacagaggagcatggaaggaagaaggaagatagttggaagaaaaaacattaattactatttttgcctcttttttttccatgtctatcttgtctccttaagaatcccaggatgagatctctcttcacatacattcctatttattggttggccttgagtgggtaggtttctatgtaattagctggaatactatggtaatattgaggatgtcagacctgtcagttggagcagccaagtgggaggtccttaaaagggccactacaatgtggaggtactttttgtctttttataagacaggatttttgatcctctttaaaaatcaaccagtcaaactgcagtctggctctacaatttctctggatctgtctgaaactgccacacagggagagggatttcaccctgggaaacgagctgatgcttccaaggtcttaaaataaggcatacacctaggacaaatattgcgtttgaaccagacgagtttgggcaacacacacacacacacacacacacactcccagatgtacacctctatctctatttatcattttatacctttctgttttaaaatttctttattgtgttttcctaagctacacaagtagaaactgcatgactgttgctgtccattaaaagactttcagtgaattactttcatctaattgatctagatttgtatttcagctgcagatttgtatctcatcatcttcaataacttttactgttgtgtgttccacatccagtggcaaaactaggaatcccagcatctgataaggaccacaaatgtcaggacaattcattggcatatgcagagagtaaagtttcacttgccgtaattctttgaccaaacaatacatgtgtgccttggatctttttacttttaggcttaaacaaggggataaaatgaaaagacagaagctcaagagaatttacagaatcagctaacattctctttactccttaacttcagttcaaatatgaataaaagaaaactaacatttgtcctaaagacctgagtcttgaagagcaacagacacagaattatgatttgtgaataagtagttgagaaatgggagaaagtattggagtaagcttggcaaatggactggggcaaggtggggaaagtgagatcccacttacatttcaggcccatgagacaccaaacaagcagaaatgaataaattatggagagttaagctgaggagaacaaaagctaaaggcatcacatggacccacagttataatttagtgcacctcacatgcagtgtctcctggagtttaacgcatttgcagcacggcacacacagatggatcatccctcagtagatactttagtttcttttctcttgttccttccatcccttcaagagtacaggatgaaaagagtttgggaacaatcaccccaaaacagaaaggcatatactgtagttctaaaggtatctaatgaaaaaaattgaagtttcttcattgaatactaagatttaaaattatcttaaagacttaaggtaatttaagcaatttgcatgtcaaagagcatttactgccttacactttataagattgtacattagtggaataaaagttctaattaaaaaaagaaaattcttccttctatatatatgtgaaaaacataatttcaagggtttctttctataaagatgaacaaatgtgatcaagttgctatatctaatggatatccagcatttatgtgaatgaaaattcagcaaaccaaaccatgtataaagaatcaaagagtgattaatggccagacaaagcaataaatattatcaaatcatgtgtactatcttctctacatcctgagcacaataagatatatgccaaaaagattatgcttaccatttttttgagtcactatgtattttttacccaaatattttgattcatttcctaaaaatatacttactctttatcatccttataagttcattgataaagaaataaaaatctatataaaataagttgagctttgagaaaaacagcatatatgagaaatcacaatactatgccaaccactcaagtatgtgaatttaattacatataaaaactttaagagcaaattaatgctgacagtctcatgcatcattttgtcaagaagataagtcatagatattgctcatataaacaaaataatcagtgtcaacattattaaaattctagaattacggtatttggtacgttatcaaaacctgacttgctgctttatcactacattttcagtaactactatgttaataagaaattagcatccaacggacattttatagttgtaaataaatttgtccatttaaaatatacccatatgttatcaaactaaaggatactgacatctcttaaggaaaaaagacatcttataaaatgctgctagttgtgttttctggttgtgtataaaataatgccagctccagtaaaatgtttacataccttttaataaatattttctttaatcacgagcaaccaaaaaattgtgtttgctttcaaacacagtttatatataacattttagaagccctgaactttgtattagtcacatcgatataatagcatgtttttagtatcaaaataagaataataagttaattacccattgactacccaacaatggtttttatttttttaattctgttcagttttttgaccaagactctactagatagtaaaatgagcgttaaataaagtacacaagatttagcaaaaatattctcagtgaacacgggatggggcaacataaaaattagatagtcacttagtaattcagtcaaaagaacccaatagaaatctctaaatactgatgaaaacctataatttgtgtgtcttttatgtctgtttgaaagaaagccagagtggggtgatgaaagtaatgttcaaagtccccaatttatatttagtggtaaaacaatttgtacattaataaaaattttaaaagaaaacaatagtttgaactgaaagcatcattttcctccttaaattttcacttaaatgttaagattttcctcttctaagaagtcaaatgaggagcaagtacagctgttttttctttgaacatgggaatggcttttacagtagttataagtttgattatatccagagacagactctcccaggggaagatttatcaaccaagtcagcatcaaccacaaatattcacaaacagttgttgaaacagttgtttatcaattatatcaaataacatttgctcagtctcttatgttggggggagggagggcagaagtcttaagtctcatttctctccctacatacttagcatatttggttcttgagcttatttattatgctgatcaagagacaaccggagaaggtttagagagcacattgattacattgaaaatggccaagagttactacaggaagaaaataggccaacagcctcagtgagagacctgaggaaaaagaaacagacctgagactggtattagtatatatactattatattataataatattacatgctatggtattataatatcactaatatataatatttacattttattaaaaatctagagttatgatattcagtatattacaatattcagcacattatcaaaacctgacatgctgccttatccctacattttcagttactactatgttaagaaattagcatccaatggacactttatagttgtaattcaatttgtccattaaaaatatacccatcctattatcaaactcaaggatactaacatctattaaggtagagagaaatctatatattcactaatatatagtattagtgatattatatagtaatagtgttggtcatattaaggtagagtttgagggaatttggagtggaagaggagagaatatggaaggaaactaccttgcaggaggaagattgggaggtggaaaaggagagtttaaaatatctttcatgccgggcgcggtggctcatgcctgtaatcccagcactttaggaggctaaggggggtggatcacctgaggtcaggagtttgagaccagcctgaccaagatggcgaaaccccgtctctactaaaaatacaaaaattagccaggcatggtggtgggcacctgaaatcccaactactagggaggctgaggcaggagaatagcttgaattgggaggcagagtttgcagtgagccaagactgcgccattgccctccagcctgggtgacagagtgagactctgtctcaaaaaaaaaaaaaaaattaccttttatacatgtaactcactttggcaatttcttgaaggctttaacttttcacttattttgcctgctgaactgtgatttccctcgctgggataatctgcagagattgccttctatcttcaggttaagtttgtttgaccagcctttcacttgaggcttttaccttttctaaagtgacactcagtcctctcctttcctctatgttttgtccagagtgatgagctgaattctgtccctccaaaattcatatgttggagtcctaaaacctagtacctcagaatgtcactgtagagatagaatcgttaaagagttaagtttagatgaagtgggccctaacccagtatgactggtatccttttaagaagagattagacacagacacacccagagggaagaccctgtgaagatcccagaagacggccatttacaagtcacagaggctctcagaagaaaacaaccagtggacactgttaccagaaagcggtccccatccagaccccgagagagggttctaggacctcactcaagaaagaattcagggtgaatccatggagtaaataaagtgaaagtaagtttattaaaaaagttaaggggccgggcccagtggctctctcctgggaggccgaggcaggtggatcatctgagatcagaagttcgagaccagcctggccaacaggtgaaaccccatctctactaaaaatacaaaaaattagcagggcatggtggcaggcgcctgtaattccagctacttgggaggctgaaacaggagactcacttgaacctgggaggtggaagttgcagtgagctgacgtcacaccattgcactccagcctgggcaacaaaagccagggggaaaaaaagaaagtcaaggaataaaaaatggttactccatagacagagcagtggcatgggctgctcaactgagcatacttatagttacttcttaattatatgcaaaacaaggggtggattattcatgaattttctgtgaaagaggtgggcaattccagggactgagggttcctcccctttttagaccatatagggtaactttcagatattgccatggcatttgtaaactgtcatggtgtgagtgggagtgtcttttagcatgctaatcattataattagcatataatgagcagggaggatgaccagaggtcactttcatcagcatcttgggtttggctggcttctttaccacatcctgtccttttttttttttttttttttaatacttaaagttctgggttacatgtgcggaacgtgcagttttgttacataggtatacatgggccatggtggtttgctgcaccaatcaacccgtcacttacattaggtatttctcctaatgttatccctccccaagccctcaaccccatgcagggcccggtgtgtgatgttcccctccctgagtccatgtgttctcattgttcaactcccacttaggagtgagaacataccacatcctgttctatcagcagggtctttgtgacctttatcttgtgccaacctcctatctcattctgtgactaagaacacctagcctcctgggaatgcagcccagtaggtctcagccttattttaccctacccctattcaagatggagttgctgtggttcaaatgtctctgacaacaccttgaccttggactgctagcttccagaactgtgagaaattaatttctgctgttgaagctgcccagcctgtagtatctgttatagcagccctagcagattaatccatcaccccttaaaatctacttttctttgctcctgtcttttcagttccactctctctttctctcctcaacttcccaaaatagccaaggttctctataccaatgcttcttaccatagttccttgcagactacccagttatctaaattcaaatcagggtcggttacctaaataaggtacaaagtaatctaggactgtgaagttatcaggcaaggggtggactgtgaaaaggacaggagggaagtgctgggaagaaaaatcattcaggaaaatcacccctggaccagagaaggaagacagaataaaaggtgcttgagagatggaagaacatagttcaccttggggatgaaaaagaagaaggaagcagtatcattaattgaccaatcttcttgtgccagacaccctacagaattaaatgttccacatgttttatgatatttaacctctttagtggcataggggataggtattagtattatccccaacttactgttgaggaattgaggttcagagaggttagataacttggccaagttctcacagaaaaggagtaattaaaccatacatctattctgatccaccttcttctagattatgggtccattatcattacactctacccccagatagataaatcaaggaagtgaaatttctaattaataaagttgagtaaacaaggctctatgctagtgtggctactcaaacaagatagagaacaaagcaacaagatgcaaagggagaaagaggcataggaaatgaccccaaagaccaaactaaccatctggaaattggtagagttaactcccatcaaaccactctatctcctattctccatcctaatataggacttaggtcagattccacacatgtatgaacattcttacttgattcccagccactaaatgattccctttcttgccatcctagcttccccatccccatccaactgtatttaaaaggtcctaggagtattctaactaagcagccaccagctgacctcatccacagaataacttccaactggcataaatgtgtttgttcacctgctgactcagacacctgccaacacttagacacatctggggcacctgatggcaaaagcacttttcaccaagcaaaacacaccttcaaaaaacacaaaaatcatggtgagttaagcttcagaatttgctggacagtcattaggaccataggatttcatttcccaagaaactctttggcaaacttaaacttttgcctttgtagctaaaatagggaaattcaatcaaaagaaagttcagataggaaaatactggaaatagaccacaagctcacaacattccccagtcctgagtatttgagccctaactattcagtagctgcttttgctgtgctctggttcctgcacaatgttgatgaaatacattttctgtgtatgtgaataggattttgcaagatgtttatgaattcagagactttactggggactaaaagcccctgccctagacactccacttgtagagttcataaatcaaatggctaaacctttcctacatcttccagacacagctagaaatgttttcagttggcataacagcaaaaacgaggaagggattataagatactcacaaccagattttaagtggcatcactaaaactcttgtgcacatgagtctgaaatatgtttaaaaaacttgaatttcagcctctctcattctaattcctctcttgcttaatataatttgaagctgttatggtcttatattaaacaatcaaggacaaagtagcttcattataagttttttgcacattttagcattaaggtaagagtgttatttttcatcactttctaaatctgttgatctttatgtacattggtgagatgtcacataagtgaattttaatcactctattgcttgttttaattttttaaagaatatttttgaacacttatcagtaaggtttttagtatactattatctgcaaagtgttgctgaaattatatttttctactctgatgattgaaatttgatgccataaagaaatttgtatttgttgtactgattagagttgtgaatgaatctcataaccttaacatccagttttaacattattgaaaatctatctcccacatactaaattacttccatgacaattatcaatataatatgactcctttagctcttgaataacttatttctgtttttgttattcttagtcaaaggtttcaaaacagacttcaaaccccaaatggattttatgccttgatgctctcatgtccagccattaatcaggttaactacagcaatttatagattaatcatagtaattagaaatgcatctttatgtagaaaagtaaggccaactaattttatctcaactttctggtcctaatattacccatttgaaacattctgcagaccagcctggccaacatgataaaaccccatctccactaaaaatacaaaaattagccaggcgtggtgatgcgcacctgtaatcccagctactcaggaggctgaggcaagagaatcgctggaacctgggagggggaggttgccgtgagccgggactgagccactgcactccagcttgggcgacaagactgaaattccgtctcaaaaaaaaataaaaacattttgcataccatcattttagtacatctctattgaaaacaaagcatcatcttttccttattctttataaaactttccaatgtttggaggaatttccaaattgatcataaaaataagttgaaagaaggaaaagtattttcagtccaacaatttaaactggctttgtgcctcaagctaaagtaaattatgtcaaggaaagtttattttggtcgatagatatgcctataaatattcttcctcttctttgaaagagggtgacagagagggtctaggattccagaaaggtatattccaaactgctgataactcacaagccaaagaaacagctgacattactacccttcatagtaaaacatagaaagatttagcccaaatggaattgtttactggcagcatacgttaaatgtctcagtgctaaaaaatctttcaaagaatatacaactttctatgccaatcaggaaactttcatggaaaatctgccttaattctcatttatacttttaaaaagtaggtaactattgatcctatatttaaacacttccaaaaatgtttttaaattcccaaaacaatttagctattattgttatggattattaatccccttataattttttacagtaatagcaaagagaaggctaattctttaaaggacattagcaataatctctctcctatatctaggcaacaaatatgtgttaatcacttactaaagtcgcaataaactctgtaggaggatataaaaacatacagtaatttaaaatatgtaaagaaaataaaatatgtaaagaaaataaaatatgaaggaacattttaagagatagattggataaaggatagtaaagacaaaggatagtaatgacaaagtatcacgtgagctcaaaaaaaaataacgtggtttttgcctaaagggtaaacggatgattttataatgcaggtgcccattcagccgggcctccaaggatggtcaggatgtgtgatcccgtgaagcaaagtgggacaccttccagcaaagagaactgaaaaggagacagaatgaatgagaaagtattcagctagaaaatgcaaaataccctgaatcttaaaatcctcaaatactgacaaatcctgcaaatattgaggcaaaagaggtcctgtccaaaatgcaaattaaatatgtgagcacctgacattagtcattttaaaataaaagtttataaaatccagcctttctttatagcaatgtgagaatagattaatatagtaatgtctgcattcctcatttttcatacacacagacacgcaaacgcacaaacatgcaggtgttctatctttttctttctctcctctttctttcttattttttaggaacagtttttcccatgactacaagaagtctcccacaacttgatcttccatcaaaatggagctttggctgccttctatcaaacatctgaaggcccattttaatcaaagttttgatgtcctctaaaacagatgccaccaggttcccaagccactcagtgagacttctcatctagatatcaaaagatttgtgtttcctacttcttctttttagccttgaaaaagtaaaagatttcgcctcagtcatcagtgaattatgaatgagagtgcaggattaatgtgtgctacgggacatgagaggtgcatatggaactcttccttactgtgtgtcacatgttaaaaaatattttttaaagcattttgtaatcctgtaggcgtgatattattttaataatgtaaagtactatctaagtgtacatcattactactctaacttgtagaattatttaaagaataaaaagttctcctcaaaaaatttctcaaatcatgtataaaaatgttatataggctgggtgcagtggctcatgcctgtaatcccagcactttgggaggccgagacaggcggatcacgaggtcaagagatcgagaccatcctggccaacatggtgaaactccgtcgccactaaaaatacaaaaattagctgggcgtagtggcacacgcctgtagtcccagctacttgggaggctgaggcaggagaatcgcttgaacccaggaggcggaggttgcagtgagccgagatcgcgccaccgcactccagcctggcaacagagcaagactctgtctcaaaaaataaactaatcaattaattttttaaaaagaccaggcgcagtggctcacgcctgtaatcccagcactttgggaggccgaggtgggcagatcacctgaggtcagaagaggtcaggagttcaagaccagcctggccaacatggcaaaacctcatctctactaaaaatacaaaaattagctgggcgtggtggcgggcacctgtaatcccagctactcgggaggctgagtaagaagaattgcttgaacccgggaggctgaggttgcagtgagccaggcctgcgccattacactccagcctgggccacaagagtgaaactgactcaaaaaaaaaaaaaagttatacaataggcccaataataaaaataagatgagatgtagttgtggacagtgttgatacatactactctttattttaaaaatgaatccatatgctttggacgcagtatcctagattttatggctagatcatgtaataacagtgatgctaattttcttcgctaaacagccatcattcctaacatctctaaatgacaccatcctaggcaagttcttcatcagctacacagctgtgacacaagacgatgtgcagcgtaaaatgttctgccacatctgcttggtctttcacatatttaactcagctttcatctctgaagtacaaagataattatttccagaagtctctgaaggaagcttgaccattggaggacatggggtgttagagatttgcttgtctttcagacagtaagaaaaagtgaaaatcttcaagaaggatttgtgaggtcctatagggaatacctgttttacagttaaatttccatcttagaggatgagaaatctactatacatcagaaaatctcacagggatgtggggaagtatgttgttcagtagtcattccaatgatttggagagctccatgaatatataaaaagggaagatcaaaacctatcctgaaatactcaaaagcccctagtggtaactggtttctagctttggcatggagttgcacacaagccccatctgaataagaaaagatgggttataacaaataaacattaattcaaatatttctgccaacacagctcagatttcactatcattgtgctaaaacatattatgtgactattaagtttccttttattaatgaaacaaattaaaacagttcctattggcttaaaattttgcaggtgcttttgattttgttactattaagtcacaatgttcagaaatagcctaatttttttcttttcctccattctacgtgatttggttatgatgagatgaaaaaattaattatgattaggttctttatctgttggtaaaattaaagaattttatatcctgtcagctaaaacagaaaaacaattgataaatagcagggatatacttggttattatcctgataaaaccataaaagttagaaccgtggattttaaaaatgacatatgtacatcaatatatatctcaccactcccatgtaggtaaccattactttgtaaaggttaccattacaataacgaatctgttgaattcaaactgtgtggcaaacacagtgctaagagctttccttcttttatcttttatatgttttaacttttaattatcaaaatattcaaaaacacacaaaagttgaaaagtataactcattctcatcattcatcctctacaattacaagctcatagccaatctagttatttctataccctcacccatttcctcttatctgcactattttgaagtatatcttcaccttcatatatttcatccataaacgtttcactgtataatgtctagaagataaggattctttttaagaaaacaatattatcttatgtaatactcaaagcaacctcatggagttggtagtattaatactcccatttcccaggtgagaaaactaaagcttagaagtaaagcatcttgtccaacgtacctagctagcatgtaatctattataccagggattcaaatgcagctctatctaaattcaaagacaaagctcctgaacattacattgactcattagtacatgataacttcacttgctagaaatgtttctgatttttgaacacctcaataatgattggtacttcatgttagcaaacaccagggaagtaaaaatagtcctaatcgcttcaagataaaaaaaaattactgaaggtgctagatgacatgaatttctaaaaactaaggtgatcacagaaatcattatatgcttctttccctgctctcttaagttcatcaaaacttacaacttaaacatacagagtcctgagtttccagctctaaagtaagaaaaacccctgctctttgctactctgaagccacagccagccctaagccataaccctgcagcccaagatatgggtaagtctcaggagtgaattctttacaacttatgacttctccacaacactgttacatgccctagttatgtggaggcaatacataagtgctgctggctggtgacagttttagttgtttgtttttaatgttgccattctacacagatccttagacaaataaaatatacattctaaagtaattttttcatgcataaggatttttctctgagtcacatgtgtcactgtaattgttgtaaagtcagcatggaattacttccatgttctgcaagtatgaataatgacaaactattacataacaaaatttctagttgaagcagtgctatgtaatcacagccatttccatgcgaattaccctagacatcattctggcctagagaaacctaacctgcaatttactattgtcaggtcacatagaagtagttgtcatagaggcgggcccttggaatagtcaagggtccatcaaaaagagtgatttccttgggtatatgatgattgaatgtctgaggaggctgaactgatagaagggaaaactgcaaaatattttcttggcattcctaacattgaacttacatacttgtctatatttaaataagattcattcccttctagcacatcttatctttataaaaacaaataaaacatactcagtaatttttcatttgccatttggttcgttggccttttcctttataatattcaactctgtgactatgtacaagcactgtggacacaaatacaggtaagtcacaggtttgccctcacaattgggagaagtaagtacactgataactataatacattgcagtataagatgtctcatgagaagaaaatatgaatgaagtgctattgggttggagatgagggtcaaaggaaggattgacatgatccaaatgagatggaattttaaaattgtggcattttggatacgcttttaggacacctcttcttagccttctttactcgtgtcacctctccaggagtatttccacaactcctctctaagcctgcattatgtgaccatttgtagtattcccatatgtctgtcaatgcccttcctggaggtcctaaaatgacgctgctaaaataatgctgctacaacatgtgttggttgaatttgagggctttgatttatttatctttgtatcacctttgcagtcctagcacagaataggtgctcaaaattttgttaaatcaatgaacaatgttaaaatttacataagactatacctcagaggacagatagtattagaggtacagatttgaaaatcaccagcatagaagcactggttgcagaatttaaagttgatgagttcccccaaggaacatggtacacaggaaaaaaagataagcccttggtgaactatcttctcaatgagatctactcttattcatgcttcctgctgcctgcttccaatcacccacatttcaccctcactcagaatgccccttatcctgcttgcattttccttttttcaactgaattttaatataccatgtaattttaacttatttattttatttactattttctaactcttgttgctaacatataagttcatgagggttgggatcttagaatattctgtccatgaaatgtagtccaagcacctagaatattataagcactcaataaatatttgttgagttaatgaatagctgcctatatttagagtactaaataagaagagaaagagcaaaaagggtagtcataatttaggaagataaacacaagatcaccctgtataatagaaagggagatatgaattttaataagtaaggggtagatagtaattgagatagctatgaacaattttaggaagaaggaatcagagaagaaacttttggatttagcaaatcaatgatgattgacaattccagaaaaatttctatggtaatgatcaaggaaatcagatagcaaaagattgaaaattgagagagaatggcatctagcaaacaccactcttttgagtaatttagtggcaaatagcacaagcagtaaaaaagaagtttgtggtaataatagggatgataaaattgtagatgattttaaaacaaggggcaaatggccatttggtagaatgcaggaaaaatactaaaaaggagttgtaaggtaatattgggggaaaaaaatgaagcaggcagtgatgataacatgaacacaggtaagtttaaccttttcaaatagtcagcaaactctttcttccaaaacactaataaaaaggagacgacaagtgctatagagacagattatttagaagagaatacaaaggggctcctgtatcatagacatttctgtgcataattgtagctatatcagtttataggtatatgttccactctgttcacacatgaatattatcaacaatatttatcaggaggctggatcataatccatttgcttactttccacctgcatggatatcagtgatgcaatacagcaagttaatttattcaaaaatatgcatgagctgcccattatgggcccatccttgctctaggcagtagagctacagcagtgaacaaaagagatgaaacgctcttccagagaagagaaagaataaagagaataaataagtcaaacatatgatatattagatgatgatatacgctaagaaaaaagagtgaacaggtgggagggaaggtaatgtcaaaaactgtggagggtctgagaatttaccctaattgcaagctaacaaattaacctgaaatggttttatggatgccagcagaagacataagactttactgctcacagcaagcagtaaccagagtatcagattgtactatttttccaaggccgaattcccacagggtgatgagaagatggccaggtgtgagctgcattataggagagaagatctgagcccagggaacccaaatactttctgatagacagcctgcctggcttttccaccacaggaagccattatcatttatatattgaaagcaatcatgtcttttctttgttctgcagatcaatgctatttctatcttccaagggtgttagtgataccaacatcattaaaaggataatccagaataaaaagcgctcagtgttttgcttacatgatatgcagaaacatgaaagacacatggagaattgcttctcaataatatcaacttcttctttaaaaggaggggtccaaaactataaaaacgttggaagaaaaccgaggcaatgccattctgaacataggagcaggcaaagatttaatgatgaagacataaaagcaactgcaacaaaagcaaaaattgacaaatgggatctacttgaaccaaagaccttctgcacagcaaaaggaactatcaacaaagtgaaagagacatcctacaatgggagaaaatgggagaaaatttttgcaaaccatgcatctgacaaaggtctaatcttcagaatctataaggaacttaaacactttacaagaaaaaaaaacccatttaaaagtgggcaaaagacttggacacttttcaaaagaaaacatatatgtggccaacaaaaatgtgaaaaaagctcaacatcactgattattagagaaatgcaaatcaaaaccataatgagatactatctcacagacaaaatggttgttattaaaaagtcagtgttggtaggaatgtaaaccagtacaaccactatggaaaacagtgtggagattccttaaagaactaaaagtagatctactgtttgatccagcaaccccactactaggtatttattcagagaaaaagaagtcattatacaaaaaagatacttgcacactcgtgttgatagcagcacaatttgccactgcaaaaatatggaaccagctcaaatgcccaccaatcaacgagtagataaagaaaatgcgtatatggtacatggtatatatatgtatacaccatggaatgctactcagccataaaaaggaatgaaataatggaattcacagcaacctggatggaattggagactgattattattctaagtgaagtaattcaggaatggaaaaccaaacatcatatgttctcaatcatatgtgggagctaagctatgaggatgcaaaggcatgagaataatacattggactttgggaattcaggggaagaggtgggggttggtgagggataaaagactacacattgggtacagtgtacactgctttgatgcatgcaccaaaatctcagaaatcaccactaaaaaatttattcatataatcaaacaccacctgttcccccaaaaagcctattgatataaaggtattaatttttttaaataaggtaatgtaaattttaaaaaagaatcattgttattaaaaagtcaaaaaaaaagatgctggtgaggttgcagagaaaaggaacacttctacactgttaatggaagtgtaaattagttcacccattgtggaaaacagtgtggcaattcttcaaagagctaagaacagaaataccattcgacccagcaataccattactgggtacatacccaaagggataaaaatctttctatcataaagacaaatgtacatgtatgttcactgcagcactattcacaatagcaaagacatggaatcaacctaaatgcccatcaatggtaaactggataaagaaaatatggtacatatacactatggattaccgtgcagccacaaaaaaagaatgagatcacgtcctttgcagaagggtagatggagctggaggctattatcctttgcaaatgtatgcagaaacagaaaaccaaatactgcatgttctcacttataagtgggagctaaatgattagaacacttggacacatagaggggaataacatacactgggacctcttggagagtggagggtgggaggagggaaaggtcaggaaaaataactattcggtactaggcttaatacctgggtgatgaaataatctgtataacaaacctccatgacacaagtttagctatataacaaacctgcacatgtgccactgaacataaaataaaagttaaatttttaaaaaaggatggagtcaggcttagcttgaatttcttcatgagaatgccactctattcatctctctgatgaatcgtactgacacaggctaagaccaaatctgttcaatttgtctcatacggccattaataaggctactaccaacagaacaccaagaagcaggatgaggccaacctgcggtcttaacctcaaccatgctacccagagtccaggactcaaccaaataaacaaagcccctaaaccatcatggccttccctagaaagtcaggtgaaagctgacatgcctaaaggctctttgttgacttctccacttcacccaaggcatcaacccagttgactgactgagcaaaggcacctgacaatgaggatgggaaaagcagccatctagaggtgttaacaggtgtttcgcatggaaagcccggaagctgaggccattctctgcagttttcaatagatttctcagtaaagttaaagtggaatggtgataaaatcatagtcagaggggtctgggagaggatggtagatccatccattatatttaagtaacttgaagctctttgggagagctgtaccagggcattttcatttctaagaaagaagccaggagtattctgaaagtaaagatttctaatgtttctctctccctcatatgatgcggggcatgaatgttccctccctgagagccagggctcttgctcttcctctaatgtcataaaaatcagtgtgtctcatttcagcagatgtaacttcatcttttttgcaattatctccaacttacacccagacctatgtagtacagtacatatagagagaacatagagtgtaggtagaaagacaaagacagttttgtaaaacagagacccattatgtcttcaaatttagcccacaagggacactatcatccatttcgtaagatgttattctaacagtcaacaatatcagatgcctttgaagctcaggaggttctatgactccttgactattagtgcactactcatggctctgcaataaaagctcatcatggtgagattgcaagtggtctagaaaactgaaaacctggcacagactggtttcaagactcccattaatgtcacccagggttgcctgatcagaccgcagcagcaagcaactctgtaaactgaaagagtcagcagcagtgaggcaaccctgagagccccactcaacaggctgtaggttccacgagccaatgtgcaacacaagttccttttgtcaggagtcacaaatctatgtgaactgtgttatggggtaaatcgtgccctgccccccgaaattcctatgttgaaagttttaaccgccagtacatcagaatgtgactatatttggagaggatatctttaaagagagcagtaagtcaaaatgaggtcattaggctcatgatgaggctatctctaatcagcaaaactatcaatcaccaagacatatatagctttattgagccttaacccaatatgactgtgtctttataggaagaggaaactttgactcagacacaacacagaggaacaccatgtgaagacatggagagaagacagccatcaccatgccaaggtgagaggcatcaaaggagccaaccctgccaacatcttgatcttagacctccagcctttggaactgtaagaaaataaatttctattatttaagccacctggtctgtgatactttgttatggtgagtttagcagactaatacacagtggtagcttctgcatcagaaacatcgtcctttactttgtgcccagtctctggtggtggatgtgttgccatgtctgggttgttgatgggtccagtgagctctggcggtcaactgggtggtggaggctctatcatcagtttgaatccagtcagtatcatcagagaacagtctctaactgtagccatctataccagtgacccaatagtgtgatcaggatttgtttccacattttgggaccccaaaaaggggtatttaatcagccaacctgtagttttccaagtggcaaaccaaccaaataggccactagcaatagcccaagtgttagtgaaaatacaaattcatcaaggggagtgttgatcagagctgggagaatgaccttgaattctgctcactgagtaaactcgctgtgtccactgtaggtactgcttagctgtgctgagattgaaaacacagcagcccaggggtactatcaagttttatctcagccaaaccaacagtgaacccagtcctagacattcaagaaaactctgtgtacccagtgtcccattggggcagcagctttgtttcaggtggtataataggagataaagatactgggaaaaaaaaaaaagctgccacttttttatagaaagtcaagataccactggagccaggccagctgaattcttaaatatatccttttcatttggtaagtaaggcttacttcccagcgtgctagtcactggatccaaattgacccaccacaaaacaggaatatcaggctggaggggcacaaggcttccatgggacagacaggcattcaatgtcaacaaacacccaataaaagctaagagctgctttttaaaaggagagtatcaggcagccatgtctaggaggccacaagtctgaagcagcaagagcttcctgacagaggctacctctaatcagcaatgccatcagtcaccacaatgtgtatagctttaaggggacatttgagttgttggactacaaagagagcatgcttcagtttgctgcacagctttcaaagtagcctattggttgggtcccattcaaagactgcaatctgtgggtcagccaatgcgaaagcttaagtagaatgctcaagagaggcacgtgctctctccaatgcccagagtctaataagatcctgagtcttttttttttcttttatttcctgcaggactgatgagacagcagttttttcttgactttcagagaaactgaacagtgtgaatccactcccaaaataagaagaacctttatttggtgagcaggccaccgaattttgttggcatttatcaaccacgtccctgctagtgaaggtgtcacagcatcacaatctgggctattgagactgaaacatctgccacgtcaaccaacaggacagcacctgtgtagtgagagctgaggacatcagaaagcaagggcactcatgttaaatcctgacccaacccagtggcaaatggcagagaagtccctctatcactgggctacattctgctatgggttgtgtcactggggaggaacatggagctttgggacttcagtgccggcccattactccagaagatgacattctttctagtttacaagacttcaagcaaacctgcccttatcttgattgagtacttataagaatgtttgcttcatgaaggcaggaattttatgcctttttcacttccatatttctagcccctaaatagtaaaatagtaggctcaagatagatacttgttgaatgcggtttaattatgaaaatgcctgattttcctactgagatgagtgacaaccactttcaggtcaaatggattctgagactatttcctactagggatttaaatatcaatttggaaacaatttataatatcattttaaatcatgtttctaagtaataaaaaaaggataaaatcaagccaaaatgactatactgccttcattgtttctaacaaattaattgttttaatttgcaaatactttttaaagcattaacgtatttatctgtttcaatgagttgacttgaggtaaaagccaggtgggacatgctaggtaaactaatgaaataatacattattttttgagaataatgaaaatatcaaaaaaggaattgcttttaaccatacacttgcattcacgtttttcttcccttgggagaacatcagtttattgatttttataattaatctggactaacagatgtctgactgattagttctggtaacaatatttgtcatttttgatatcttctcagctgttccatatgggatttttttttaatttctatagtttcttaaatcagagccaatgtgtagtcatttcttgacatttatgactcaaattttggtactgctaaacttttaagaatttctcacacttagttctcatatttctgcattcttcacagaaacaactgcaatctcctctttcttcaactttaaggatgaggctgacactgtcaacactgtgagaaaagtaatgctagatgggggcatgaatatcctagaagtgttctaaaaaggagctttgttagaggacaggtaggtagaagatgctgaaaagcatggctttcccagatgccctttctagtatcatcacagtaagaaacagcggtatgaccaataaaactaaataaaacaaaaaccaagctttgttcgggtagtacagtttgtggtcaagaacataagttctggaattgtacaatttggatcccagttctgactctagctcatgatcctggatgagttatttaaccactcggtttcagcttccccatatagaaaaatgggattaatagtatcccaaccaaccgcactactgggaagactaaaaagagaacacttgcaaggcacttatcacaatgtctggcagacagtgaattctcactaaatctttgctattaactatcgttttgaacttcaattggctaatcatacttatcaaaataccttctgggaagtgcaagtctttagtcaatattgcacgtgtgtttaccaagggcctactcagcaatatcgcagtcataaatactcattatgttgctgataaagtctatcttagccatgttctctagaaacagagcccaaggcaaagcagatgtgctaacactttattgggggagtacaatccaggaatgcagtcatgaaagcaaatgtgagggagatagaagggagtgtgttgttctggatacagcttcatgataagttgactgcccttttgcacaagatctctctggtggacgtttatgaaagtatggtccttttagggtaaaggagagaataaaacttatctaccagcactcacactattcaaaatttgccccacaaccattaacacttataggttctatatacacgggtgaccatcagattccctagtatcctgctaacttctcagcagcagggaagccacaggaccagaaaaagaggtgttcattgaggagagtaagttaatgatttaggaacatttctatgaaaaacacaaggaagtatggagaaattgccacagcaggcccactcatctataggaacagggacacctccggccagagagcaaggcaagtgcatggggctggggtaatgactcagctcactgatgcacacactagcttagggagctctgagctgagggaaacaggattgagaattactagactaatcaaatcatacctctttcttttctaaattttctgggcctggggtatatcaagtttatctgaatgtctcaagctctcatggatggacttttctatctccattaggccccaagaaatctactatcgtaactgattttcagtcttttcaaatcccattttattatctgtcatatgaatgaatgaaataataaaaaatcaaatacagacaaaaaacaactgaagcaacctataacagtacagttagaaaacatgacacacataaagaaaagaacttcctcaattattgttttcaaaagtgatgttaaaaactgctcatattgaataatatttagacaaaagtatctttagggtgtctgtgcaagttagtgtttcacatgcattttactgagatgccatgatccctggaggcaaaccagagctactttgggtatatcacataactgaaaaatagctactttatctcaaagaaaatatgagataattggaaaactttaaagaaatattctagttaaatctgaatggaaagaggtgtgaaacagatgaaaaatatgaagattttttagatgatgcctggctcacagagatcctactttagtctgttagaccggcttcaccaaacagcaaataaattgccactgcactgaagtgaatttgatcataacatgaacaaaaataacagcagttttagaaattaaaaagaattaaagggagaatggtacactagatcatctgaagcaggtctctaatacattagaaaagctggacaaaatgtataaaatatttactttaaggcatggtaaagcttacgtgttaatgaagttactagttcaggatcctgaagtataaaagataatcagaaaagtaagtccagctctgtggccacttttcccctgttttgtggggttctgtcctcttaatctgaaagagaaaaggtgagagagggaatggtgcttttgactgagagaacagaaacagtccagagcctgccaaagggagttcccagttgaattctccttattttgagttgaaactctggaggaatgaaccttcagatgaaaagggtgaaagaaaagataagagtggggtggtggtgtacagcactcataggaactgtaattgagcttaaaatcatctcaatactgaaattgagttaagataatcccacttggctcgtgcttccagttacttggtagggggaaaagcaaatcctctctggaaattacaacagtaccctgttttccagaatattattaaaaacaattgtgtaaacacaatgttcagagaatattttttaaaagcaggtacaaaaaagcaacactagtgaaaaacagcaaaaacaaacaatacaaacacactcacaggaacacctaatttggagttaacatttactatgttcaaggtcagggacaatatttcaaatttaagtagagcactaaaatctatttttaaaaatgaaaatttcagaacagaaaatgaaataaccagaattaaaaagctcaatggatgagttttatagtaaatcaaatacggttgaagagagatttgtgaactgagatgtaaatccgaagaaaattttcaaaatgaagcataaagggactaaaaaacagaaaatacagaagagaaaataagaatgattcggagatatagtatagtataaaagtttaacaacaatggatagaagctccagaagaaaaaaggaagagaatgaacaggagttatatttaaaggcaaaatcactgggaatgttcataaactgatgaaataaatgaagccaaaattgaaaaaactataaatgcacaaaaaggaaaaactaaaaaataatcagcaactactcacatcattataatactaatgttgaaacccatgctgaaaactaatccaaagagaaaatcataaaagcaattaaaagaaaaagaacaggatgggcacggtcgctcacgcctgtaatcccaatgctttgggaggctgaggcaggtagatcacctgagatcaggagtttgagaccagcttggccaacatgatgaaatcccatctccacaaaaaaaaaaaaaaaaaaaaaaaaaaggaaaaagtagccaggcatggtggcgcatgcctgtaatcccagctacccaggaggctgaggcaggagaattgctcgaacccaggaggcggaggtttcagtgagcagagatcgcagcactgctctccagcccgggcaacagagcgagactccatctcaaaaacaaaacaaaacaaaacaaaaaaaaataccttccatggagcagcaattagaaggacagctgacttctcaacagaaacaacatgagcaaacaacaacaacaatttaaaaatgcaaacaaaaaaacaaagcaaaagacaaaaaaccaaaaacccagaaagctatatttaaagcatttaaaaaataataatctaaattagaattacagtatatgcctaacaagaataccctccaaaaatgaaaatacattttcagacaaacaaaaactgggcaaattcatctccagcagacttgaacttaaagtatgttttacgctgaagaaaatgtttccctgaggaaaactcagaaatccaagaagaaatagagagcaagaaacctgatgcatatttgggtaaatctaaatgaattcggtatctgataaaagactcctatagggaatgtctttgtaatgttgctaaccaaggactaaaacatcaaggtatatgcagcttcaagtgtgcctccaagttagcacgaccataaccttgagttcagctgcttttgcttcagaactctgctgtctaacctggtagccactagccacacgtgactactgagcacttgaaataaggttagtataaattgagaaatgctgtaaagatcaaatacacactgaaatgaaagaactttgttgttttgttttgttttttaagtcagggtctcgctgtgttacctgtgctggagtgcagtggccgatcatggctcactgcagcctccaactcctgcgctcaagtgcttcccccgcctcagcccccaaagatactgtgattataagcataagccaatgtacccagctctagagaacttaattttttaagatataaatatcttattaatattttacattgcttaaatattgaaatagtattagcatactggattaaataagatatattattaaaattaacttctaatttatctgttgcattttgtttgttctaatgcggctattaaaccactaattacatgaagtatgtggtttccattctattattactggacagtgctgccttacagcgtgggttccattaactcaaaatgaaaagtcctgtatttgatgcctattccctgaaatcacagtgcagtttattaatagcagagatgatgataattcacaaacactctgtcttcttccctttaagataaagtagcttttaaatttatcactttaagagttatatccatctttcaaacaaatttctctttcaaacccaatcaatttgtaaggctataggtgaatataagaatgcaaatttacagcaacagcagcagcctcagcacaccacacattcactccatagaaacactttgcattttaggagctaaccatattgactttagtggaagctcaagttgcttttgaaattatgaaatataaaatcactaaaacaagaaaacaattatgtcttagagatggcgtatgtgttatttattacagtatcttggtaagtgcttcaaggtttttgacatgcaaacaatgttgtcactaggaaatgaagtgagacatcaagatcagtccagaaaccataaatgtgaatgtccacacacaagcatgcttgatggcacagtagagagagaaagtatgtggaaaacattatgtgtgtgtatgtaggtatatggatatgcagaattctccccttttgagctcaaaaggacatttactgtggtcctccttgcaagtgttcaataaccagctatttggaagacaaatttgttctgtgacattgtcttttatcttcattccaggtcctgttcccttgcaggttggtgtgtgcctgagataaagaagtgatgctatacaaacattaccaactgtttgtgggaatgaagtacttctacacttctcttcataccaaacatgaagccagaaatatgatccaaggggcacatggacaactaaacctgatacaagatgaagtaaagttaagaggaaataacaatagagaaaagatttttatgtgtccataagttaactccctgaagcaccctcataccatttctttaaattatcaggcctaataaccatgtttctattctgcatattaaggggattcacaacctgacccatgccaccactgcaacctcaacttgcattactctcacatgggccatttacactccagaaagatcaactttcttatactttcctaagcatgtcattttctttcacacttacgcttctcacatgcttttctttctatatggagtgttcttcctcatttcctctggtggcttaaatctatttattctttataactaagctcaaatttcatatactcagtgaactttcacttcataaaaatgatttttgaaattcatttcaaaacatttttagttgagtttgtgaaaaacatatgaaaatcttgtgatttaatctagaatcttttcaaggatcttattaacaattattcaaatgtaatgagcttgtaaaagcctagactataaaacaaacacacatacatatatacataagtatatacactttcctaattcccctcagaaagtaatataaggaattctatatacatccatgtatgtaaatatacgcacatacagcatatttatgttaaacaaaactatgttttgccactatatttgttaatgtttttgaaacaaatagtaactggagatatatccagtattattttgttcttagaatattttctcactaaaatgactgaaaacattagcttatgatgcaaaaacaaactacattatatgaaaaaggatacaaattaaaatctcaacttcagtcatgacaacaaaaacatatttctctttcaatttaatttccatgagaaactattctaaattaaaaccttccagtgtagtgtctttcattttttgcatttttactacctagggatcaaacagtttgacacagcaaaaattctggtgagttaggaagaaatgctgattggtttgttggctggtggccgggggaatgttatgaccgagtaattacgtgttctggacagatgcattaaccaggcttggggctggagccactggatattattttagtcataaggctagaggaactgaatcattttcaaagcattggctggctgacattgccttactgatgcctgttccaatgactctttggcagtaacttccaacgctgcacttatgacatggtaaacaaaaactacattaaaggtttgctttttaatcatgaaggagttcaacatttccactaagctctcttgctatttatcaagtcacattgaaggctattgcagattttcacagtcctgtcttctgatagaagaactgtagcaatgtagcaagcagaaagctttaggtttttcacagcattaaaaaagcatatgatcaaaattcaaacggataatacatttttgcaactgttctcactatgagactgaaaattgacaatgtcttctgcctttatcaatgatttatttcaattcataaaatgtcattctttataaagcatctgtttaatgattagagaaatatataataacacactcaatatgatagcatttggcttctaggaaaagacaatacgttccataataatcaatcaattggttaggttcgggtagcttttccttttgtgccatttaaacctgaaattttattttgacagcaggtactaattacaaacttcacaataatttaattttaaccatgcttaggtatctcaaatatctttgtactgattactaaaaagcttaaataacataattttaatatgatataaaatattcatttttgctttttttaagtggtttttgaattatgagggcatagtgatgtttctcttaaatatagctctactaaagtaaaatgcaaataacagtcagcttttcaggacatttggaagtcttaaatttttttttcatattagcaaatgattgatggtattcaattgctaatatgaaggcaaagtaggtgatggatggatggatagatagacgttgatagatgagagataaaggtagataaagatgagaatgtttcctttcttcttatttattttaaaatataataactacgagctttaaaactattaaataggagtattagaagatattcttcagaatcaaagagattttaaaacatttttgaagaggcatcattttggttcagttttgtaatattattttataattttttttcttctggttattcacaaagcatccattaacataaaatgaaaatcactttgctaatgtaattttttaaagttaattaacactcaggaataagtctatctgagttattgtagtatcagtgcatatgtcatagctaagttatatgtctcttaaataactgcaattgaaatttctttaaaaataccccaacagaagattataaactagtaatgaaatatattaatgtgatcattaaaatcactgtaatcaccctattatttttatttacaaaatttactatttaaaaggaagtgttattctcttgtactaaagagttttatcaaaaggctggaggggtaagttagttggaagacacttactgaacttgtgagggaaaatttagaaaaactcccctctaaactgcaaagcagttccagaaacagaatataaatcgacactttatgtaatatctgaaaaggacttactgagagaacatttttaaatgtctctaaaaagcaaatgcttataaatgaagccacaatgataaaactgatacaaaaatttttcctagaaaaaacggagaaaacaaaaagaaaggaggaaactgggttggcaaagaaaagggcagatctaaaagcaccaactgaattgtccgaaatcaaattgcatcatgttttaagaaatgatcatttgcttatgcttctgaaatataggttatgttaaattttactgtgtgaagaataatctagttggatcaaaatattgaaatataaataacatattataattatactataatgaaatattatagttcatatcagaacttaacacataaccaataaaactaacagaaaagcttttccaggcaaagactatgttgtctattacaacagtaaaaacacagtgtagaaacctctcattttttattcctgttcctttcgttgctctagggactcaaacattcttacaaaataaattttcttaaactattttaatcattttaataaactcattttgctctgaattgttactaattccactaatagtgttaactggtgcaaatagttactaattgccacttaaatcaatcattggataaataagtggaatattaattagcacaattttattatatgtggtatattctattcttttctcaaaaacaaaaaatcaaaatagttgatagtgttgtttaggttgtacaattaaattatttaatgcaatgtttgtcacataatggatctttaagaaatatcatgattaataaattaattttctcaatagatggacattttttgtttacaaagtataatatttagcatatttttagtacttactccatactcctagattgtttacattcaatacatgtgctaggtacttaaataaattataattattttatttttaaatataaaaaattctggaactcattttttcaagtttgtataagaagattttttatttttaaaacctctattcaataagatgtccatcttgttaaaatacaaaaaagtgggtgggggggtggatcaaggcaaagaaactttgggaaaaaaaaggtctttgaaacagcaaagtataaaatatggtgaaaatgatgtttaaaggtattttattaccataagctgcagtaaatgtgaacttagcatggagtgacctaaattaaatacagaaacttacataatatttcctctgatggacctaatgaaaatacagtatttaaggcaagcttaaaaaaaaatactatgaacaaaagaacgtatgttaatgtgaaacaatcctccactaatgattttctttaaaaagaaaaaactttttataaagcctaaacaaggcagaaaagacacacagacacacatctgtcatatgtttgctgctttatggtcactgctttaagaaaggatgtgagttatgaagtgagtcctttcgtaaacattgtaataaagcctgggtaagatatacaaggcatcagaacccttcaagctgctgttctctaaataacactaagaattatatgagcctccaagttccttgtataaattgctacaccagctcaaaacactaggctgctttatcatttttgaatccttttcagaaaacctgagttcttccttcactttacagagaggtgagaatgcagcagtaaagaatctgtattttatcaaatgtccatactttttggagacagagatcagtacatttaatttatgagcactaattatttttcttccccttctaaaatctcaattcattaacactgttgaggataccaaagatgacatgagcaagaacacattctaagcatttattcttccgaaagagattgtaaaggggacacagtagatcaaattaacctctgattactttgctagctgtggtctttaagagccaaaagagagaataacttttgaaatctattttgaaatagaattgagtgtagaaacagcagtagattctctcctcttggtctcacctaccttttctactatttttgaattaaataatttaaatcctttgggattgatttctgcagactatttaaagaatttaaaattccttcctgtcttcagactgtagtatagttgttcaactctatttctaataactttaataactctttttaatagcttatttttatcattcaattctaaactaaaaccaactcctgaaaaaggaaacgttatacattataaaataattccaataattacaaaaattgaagaaaaatattttctttggtttctaaaaatacttaaagaggaggcaatgttaatacagtgagaaaatctctagttgaagaaagaaaataaactgaactcaaattaacaaatttttatcaaagcattgattgactagttttaattattttatgactatttacagtgctaccaattgaaaacaacaaaaagtatataatgacagaaaaaaaataagctaaaacacaaaactaaccatacagtttaagcatatggctcatacaggatatggaactatactcagcttcctaagacattctaattagtgtttcctattatctcataaggatttatgtcctttaaatttactgctaaatttagtctgtaagtctaatatcattaatttctttttattttctacaatagaaattacatatggaaaagaaggactactacaaaattagatgttaaaagaagaacgctaagtgaagcaaagtttaagattacagaagttttagggatctttaaattcttatttttctgttaaaaacacccagaaactcttgcacactcactctttttgactgatactatataatatttatgcatgcatgacaacaaaatatgtttcaataaaaatatatttgaactagcaaagcaaaattgctttaagcttttgatctatctcatagctcacatctctgaaagtcttttcctttcagcagttacattcaaaaagtcaaagatatacagctgacgattcaagctgaatgacaccacgataaactatggtttctcctacagataaaatacatcataaatcggtgcaacacttacctcattttaaatattactgtctccttttatcaggtaacactatatgacctccttttgcctcccttcttcccatattttacatgagattttaattctatacaatgatcacaaccagaatttatttaattaaaataggatatatggctttaaagggttaggttatctgacaaacagatttaattttaaaaaataataatgaggacagactgacttctaatgccccgcaaaatgtggcaataacagaattatatttatttttaaattgcaataactctttatatttaactgcaatttatcacatgatctaaaatgataggcaatgctgtttaagaaaatagaaatgcatatccaactaaacgacaaagatatgtctgcagggagtgtatgcaacataatatgcagcttttctcattaaaatatctattcctgaattacaacggccctatcaacactgtgtttctagctaacggcttgatttaatcctgttcagtctccagccagaagttattctttttctgaatactcaacttcagattacactccccaagctattaaatgcattaaatgtaccaggataaatcctgattatcatctacacaactttggattcttatccttcatcctcccaggcctgctgagaggtaggctttctcatttagctgaagtaaagaggaaggcgggctccccctggtcaggagagagtagctgtgaatgaggccccacggtcatcagacaccccagagttggcaacttgtgcttccttttccctctgtggccaccccagagcagacatcagtgctggccttccagatgcatcaatcttgtctaccacggaggaatatcagtcacaaagaggcttgttcccatttccagttgcttttcatctgaaagcagcattgggaaaagaaacctgtggactcaatcccgtcagttcttatctttccaaaacatctcggaccaaagccacggaatgaactctcaaccgtatcttttcatcagaaggtccatggccaccccgatctgatgattatttcacacagtttcagggagactcccaaactagctgaaaatctctactgtttcaattgatccttcttaaaattattatcttttaccacataggggctacttactatgcgagatcattatatatacaagtaaagaatatatcttattttcatatagtatgcaaaaataataaaatgctttttacataatcctactggttttaaagatttctgtttaggccttgcattatgagagttttcaaattagcagtgatggatttttgttgatatgtagcaagttctatttcagcacttcaggctctatgtaaccataccccatgtgtttgccacaccactgccttgagttgacctggcattgaaggtgcagtctataaccctgaaacagaaagaagccaatcagtttcagcatacacccccactggctatgccaaacccatattcctcaagcctcaactttacattcaaggtaaagcaccccgacttgaatattctcagctttccttctttcaaactctgaacagcattacctttatactgtcgttttcttttcttcctttctgactcaaaaaaaaatcagtgtcttcttttccacatgtaagcctctgcacctgtgcttaatttcatctcctcccacctccccaaggagtttgcatcattaattatttgttcttgtctttgccataaactccttccaatatgccttcaaagacttgtctctaattgggaaaaaaattatttcatgtgtccccatcgcattcctacaactatttttccatttctatccttcttttcattgctataaacttcacgagcacctatttttcttctcatatgatggaacgtaatccactcattattaattacttatttaatgtctgtcttctcataacatcaactccataaaaacaaggattaagtctgtcttcttccagtttatacaagtgcctaatgcagtttgtagaacatgttagacattcaaaaagtattgattatactggattatttaatcttttttttttttgaaatggagtctcgctctgtcgcccaggctggagcgcagcggcacgatctctgggctcactgcaacctctgccttctgggttcaagcgattctcctgcctcagcctcctgagtagctggaattacaggcgcccgccagcacacccagctaatctttgtattttttttttttttttttttcatagaaatggggtttcatcatgttggccaggctggtctcgaactcctgacctaaactgatccgcccaccttagcctcccaaagtgctgggattacaggcatgagccaccgcgcctggcctggattatataatcttaacaatgttacttttttgttgtcgtttctcatcacctccactataactcctgaaaatctggtttctaccccctccactctcaaggaaatgtacattcaccaaaaacatatgctatattatttttctcaacacagttacttacaaatcgataaataaaataacgtattctcagtttctactccttttgacccttaaaaatctgacgctgatgttgaccctatctttacggaccctccggcatactggttctcctcacccctcctatcactttgtctcagttcatccctccaacctttacaaactaaccccaccacctaacgcccagcctgcttgcttacactattgtattagactccaacctctcccactccaattcacactgagtattaataggagactaattccctcctattcaaaaatctcaaaagtttctcactgcctgtattatttaaagtctaagctccttatcctgacattcgagacccccttcataatctgtaccctaatctctccagccatacccccaaaattacttacacccagtcccttctacttattgaaaccacacatgtcttattttcctacttgatacttttgcttcatgtcagttgccctgactagaatgcttccggctactatcagtgtatacaaatattcttcatcttttctttcttttattattattattattttgagacaaggtatctccctggctggagtgcagtggcatgatctgttgcccaggctgttctcaaactcctgggcttgaggaatcttcccgcctcagcctcccaaagtgctggaattacaggtgtgaggcatcgcacccagccttatccatcttttaatattcagtccagactactgtttcttcattaaggccagcacaaatttccaaggtatcttggtgtccatttgaacgattattttggaagccaaccatgtgcttaattattttattttgttagttttataatagttgtataatacattctcagtgtttagatttcaaggtgtacaaaagtgtttaactgtcttccccacaaccttgtccttcagccagcaaggttccctcctggaagcaaccaatattatcagggatctttccagggatctttccagggataattcattagaagcaaatggaaattactgtcttttcatatgtttagcactttgtaccaagcaaatatgtatctatttattttttctacaaatatttaacattttatgtacatacaagttatcctcctatttatggagtctatgtgccttggcttctttatattaatgtctgtcaaataaatattcattgattgattgtgcaattctttttttcaagtctgggatagactatttcatggtaagattgactctctacccccttctcctcaattaagaaagataataaagtaagcagtcggtttttttcaaacacttcctccccatacacagtccttaagaggaaactgaaacatgactaatcacatatgcagatgtgcattgttttactgtgatagtttaatatgttccagatacaagcacacattgccatgtttcctttggttctgatacatacgctgatacaaagattagcaaaattgctgatttgtaatggatgattctgtttcattttagaactctcccatccctgcagcattccaagttcactaaaggtgtgtttgcattgaaactttttttcataattacgtctatctccatttcatattgcacctattagaaatgacatgacagcccacccaccttgttgctgcttcctaaataccctacagtttcttcttatcttaaacatatgtatcaatttgtgaaatgataaaccccaaaatgctgttttatataaagaaataaaataatgcctaagtcaagcgttggaagcaaagtcagcttcattcatagttaaacattgtacctggcattactaatttaaagtatcatacagaatataatagatatttggaatcaaatggtttatttgaccaacagagagccaaaccacataagctagaatgcctcaaaacccattagttaaaagagcctttaactatcaaattggctgcttttaatgcatcagactctgggcatgtgccagatactcccttgatttcacaaaatagaacctcaatgtatatcccacacacgtaccttgaattggaattatttcctttttattaatcttgtatttaaatcaatgcccaaggtttaaatatcatctacaaagacacaatttttcttagaaaaatgtatcttgaaccaataaatacaattttagtatgtatgtaggtatgtatttacatacacagtgagatgggacctcactatgttgcccttgctggtcttgaatgcctggcctcaatcaatactcctacctggacctctcacagtgctgggattacaggtataagccaccacacttggcctagtttttcaaaattaatgtaggctatctttatctataccagcacagatgcttttaaaaacttgaaaatattttttatcagaactacatggaaaatatcagtattttaggcttacagttttagtagctattaaatcaccaaaatagtaaaaaatgttccattttacttgattcttcttgatgactatttccttcccagctaaacacacacacacattttcacaagctcacgcacaagcttactcacctaaaagtctcataaatataaaatttatgttacaaaatattcaggtgtgagtgagattaagtaggaatcaataattctgatttgtcataaagattgagtttatttttatcctcaattttaataaattctgttctgggttttagttcagattatgagtatatattatcataaatggtttgaatatttaccaacacagaatttagtaacaagtgagatagttgctaagacactgttaaggtaggttggaagcacttagttttgataggcatgatatatagctagggaagcaagtgtatgcaaataattatgctgtctttgaaagagtggcttatttagatgtagcatagccaatgagactgtggtagtacttgtgaaacttacaggaagtaattaaagacgcacagattctcttcttttactggctgtttctgcattacatagagattatgaagagagacaagaagaatgacagagaagcctgaacagcccgtcacattttcaactaagaaaattgtttttttccataggcaaactttctagttaacaaacacttgttgtttttattttattctctattacttgcaagtttgggaaaaattctgatttctacattttaacaaagatacagacatgtttattctccaaagggtttgttctctatgtcaccagcattttgcaatcctcttcatcctcaggtcctctggttggttgccatctggcagtttacctttgattttatgaataaggtccccaattgtttttgcagctgttatcagtgcagcctgatctatttcgaatggggataacagaaaatatatctccacaatgttctctgcatttcattcctgtggctctcttcccagactttgaattgtgatttttctagtgtacattcctcaacacagatggtgacaacacagatggtgacaacacagatggtgactagacacttggtttaaagaagatataaaagtgaatgcttcccagtaatcattgtttataaacatatttatgaatctgtgactatgggatctattaattgtacacatattttatacatatatagttattctcatcatggccgctgaaaatgcttctaattatacgatttctttctgcctccgattgtttcttatttttataaatgatgtttatatcttccatgctgaccccatgaaagataataatgttaaaactgtattcccaggagccccggggaagaagtgaaaaagatgcgagtgattggctgctattaatattatcctagtttacaaagtaataggtccatcagtctcctttcaaccaaggtagtcattttgaattgatttcatatattagacttccaggtaacattccatttgaagaaaagatttcactactaatttagaggataagtgaattcactcattactagagatggcctggccagttcaccataggtaaacaagatattattgcagtgaaaaggtcccttacaagcaacctccccctgagtatttccccttgtaaacaatgctgcctacaatttctacttctagtcccatctttttaaaggcattgaaaacattagttttagggcagctataacagagtggaccagagaacacattaaaccatccattagcacctccatacgaataagtttatctattagctcttgggacctcgagaggcctggagaaaatctagtaagttttggtggatcaggggatttaaaaaaaaaaatgctccctgggttgtcactttagggaactgtaaagtactctgaagctcagggcagtggaggggtgaagaaaaggaatgcaaccctgagcagtagagggcagtgataggaaacccaggctctgacagttgaggcttgccaccaagagagtggagggctgatccctagtaaaggggaaggctctcctccaccccttcccttggtcagccaagcttctacttccagatcaacatagatttttcttctctgttataagtattttatttttctgatcctttcaactatcttttcattttaactgaatcttactctaaaagccttctgttgtcaccaacaccaataataatttctaaaatattcaacccgagttctgttttataaaatattataatctgccccaaatccatgcaagaaagttttcaaaggtctgcacaaaatttgttatacacattgatgtttagtgcctctatttttgcatagaaaattattgataaatgatcatctaaggtgctaaagtgaaatgtgccataatttctcaaattatattctccctgcagcaagatgtgggcagagcatttatttaacttttgcaattttttaaatgaaatgagaaaaaatcctactgtggctagtttttacattatattaacgtgagaagtaaactggagtcatagctgtgactcgctatgtgtgaattattagtccacatttccaggcctacactagaggaagtttcctttaaacatacctctgtacaaatggtaattttgtgcttctgaatggagagtgattcctggttaattctgaagccaagtttatgagcagcttaactttacaaaagaaaaaggaagcagaaacactggattttacaagtaaagtttcagtaaacgtcagcttcggatgacagtgggaactaaaggacatgggacagagacaatgaaacgaaaccagaactctacctactgttttcttaccaattgtccctgcatttatatatgaaattttcagaagcgcatggtaatcttgccatctaatcctctacagttgacaaagtgctttcatacgcattttctcccttttctgcaggctatgatccctgaacactctcagccttgtcagagagacctccaggatgctacttgaggctgaagagtagcgttctgggtccccagctcagtaggcaccacctctcagggaagtgaccaccactacgctctcagctccgcaagtcgctggacagtcaatagcgctcacacggtgtctaccggatctggcacggtcaagacacaggaacagccgtactttcctgcgggtaagaggcttttcttttgtgcatcacgtgcagaagaagccactccgaagtgcaaacacctttctaaagttttcagtgcttcctaaaatgcagacatcgacgccttgctgagttatccgatcctttgatgatcaaataaaattaaggccagctccctgctgtttgatctgtggctcagtttctctaagggctgccgcgggttccgcaaagactcactccagaatccccagctccctcgcgtcagcgaatgtcccgctggtccaggcagccttttcctgcgcggttcttcagttcctttttctaaagctctatttatacaaattacttttttcttcttttcattaagcaatcaggatttattttcttttctctctgtatcagccatggacacattcactgatgaagaaccaatcaacgttttgtgttcttatttatttttatttctgatgaggcaggttccaatcaaagagcaaagtcagagaaaataatcaaacagctcgcggtggccgctttgcctttgtttttattctagttttctttggtgggtcatttttaattctcttctttgttaaggggtagttaaatctgtatctttgtgctcagcaagagtggcccgtgtagttaagaaggcccagagagcttccttgccccagtgttcaatgggcagcttcccttctcactgaggaggagactttcagtggagaaagagaaatggaaaaactttccagcaaaatcagtcaatgcatggagaaacctgcctttcaggagctgctaattctttcccaggcaactcctactcccctagagaggaggaggagaatgagacctcaggtaagtaaaagatccaagctcagtgctgatggagtgagaaaaatccctctctcagtgagggacagaacctgctttttgtcttgaagtcggcattgtgttactgaagatgtgggggccaagattattttcaggacactaaaaatctgaaattgttgacttcataagttgaacaatgaccaacaccagttgagaatggcctggagtacccttcatcttaccccccaccccagcaatgaaaatagcctctgtgagcacaaaggtgtggagagtgctatctgctattaagcacatcaattacattgtggaaaggctatgacttaaactacacataatgaagatacttcttaggtgacacagagaaaagttttgaccagatgattggcgttgttccttacgtttctgttaaaaatcacatcctctcagctcccagcccaaagtgagtcctaatgttaacctgagactccttctagagtggaagctctaggaaagggtctgtgtgtgtgtgtgtgtgtgtgtgtgtatgcgcacatgtgtgtctttaaactgttgtgtgcatgtgtgtctttaaactgtgtccccagtgtctaaaacagtaggcatcaagtaaatatttgtgaattgaatgacagaacattagaagcaacactaccatccccactgcaccccacccacccaccccggtgaaaaatggaatttcccagccaagattagtgaaagaaggaaaagacaggggttaaagtgctctttgccagagttttgggaagaattggccacctggtaaaataagtactgacccaacgacatcttcgcctactctttataataaagggaagtaaaatcacaggtaaataagatgggggcgttgccgcagagagtgcttctgagggtccttctctgggatcttggaaagaagatatcctggaacagggggctcagttggaaggtggcatacacattagctttctaaaattaaatctataaacacaaaactgcagaactttcaaactactgtgtaagtaaaggaagtctctccactgaaagctcagctggctgttaagtgggttttagaaacagctctagtaagcgaacctatctgcgattttcgggtttccattcctattcgacttccctcctctgggtccttaccgaaagggaaggtcccaaaggaccaccagcgcgctctcggaggctccaggactagacattggactcccacagcgcaacaccatagggactccggtgttcggttcccgtggccctctccttggctcccggtcaccgtcctcacaccccctggccccagttactgacggaagccatgtgcagctgccataatgtgtataaaagaatctctccctggcgttggtttcttctcttcttggaatgcttttggcagatcctccgcgttttccgggtctcttgggagtctgaacatgcattttcctttatttcagacaggattccgagtgttaactagattgtgccctccccactacctatcctgcccatcttccttctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgggtggtttcgcccccctcatcccctcggtcgctggcgcagattgatcctggagctagttacgggtgttaaactggtacgcgggtggggcaattcattaggcaagaaatggattagttgtttattatctataaacattccaaccacagcaaccaatcataaaaccgcggaagggcctgtaaagtaaagcagcagcgaagcctccatgtgggcagctcaggcttagcgattgttcccgggtgataaagggtcgattagggaagtagagctaggaaggtgggggcgggggagcgggcgataattaagcgagtcgtcaggaaattgctttctagatggggatcatgatgcctctaacttgaacggggcaggagaaatattggggtgatttggaagacggtgataagggaaagcacaaaataaggattggagggccgcagtgaggtcattagtgaagctgatgccggagataaaagctgttgattaattgaggggagcaatttagtctttggtttcttggtaaaatgcttagtcactaaccatgaaagcggcctaataatattttatgggggtggggaggagtttaaaactggcatctttctagtagcagaaattcacctttgagtatggctttttaaaattcctctttggaataaaacgttttctaataagagttagtctcaaaaaaaagttaatattaggttggtgcaaaagtaattgcggtttctgccattactttcaaatgacacaaaccgcatttacttttgcaccaacttaatactttttcttttttaagtataaagcttttgtttttaacaaaataactatttggtttctttggggtttcgtaaaacaaactttaaactcattgcatatttgacattttactatattagaaagtgatgaaataattatgctggttttcgaataactaattcaagtatactgttttcactttgattcagaacctattactcagaaaacaagttagtggcaaagttcttaatcgtttaataaatatattggtttggaaatttattagaactaagatgtagaatatagtaatatacacacgttagaggtttcctttctcaaattaaaaaaaaaatggtaatttaagtgtaaccgtccaaaaacgggcatgaggcataaatgaaaagtttgataaattattttttaaaaccttcttatggaatttcttagatcaagataaagagcgttacctgcatcccagaaattcctctcctgcaagatgttttttaaaatcaatttattagatttttgttttggggatgtttatgtttaaataattgctcatcaagtgcttggatttcttttcaggacgagtattgtagattttcctcccttggggactacttgcctaaaaataaaatgattcgagcattttgaagaaggaacaaaaacagcctccacatccttttttttttttttttttttcctgcctctggcagcccacactccttcccccagctttctttattccatatgagagacataacaaacaaacgattacatgttgaaaaacacatctgaaaacagaaaggtcacgttactaccgagtcctggggaacattaatctgatgtttggaaaacagttgacagttgaaggttggagtttctcttttcaactcctggacagagagagagaaagagagacagagagagagagagagttgaatgaaaaaaagaagggaagagaccactttgtggccttttcacttcaggaataattgagggactgccaaatttctaacccagatttaaaaatgcaaacacattcacaaagaggactaacgatttgaaatggctcaagttggcattgactctaagtgagaaggtgtgtgtgtgtgtgtgtgtgtgtgtgttgtcttaaaataattaatgtgaatagcgaaaagtaatcacgataacatcaagccctgcatgcctgaggggagagtttgctggacaaaaaacagtccctttactaatagcttgtgagaaggtgaaagttgattgcctgaccactcgtctctctccagcgtttctctaagtccgagcccccatctctcccagtcctcccggctcagcgaggaattccttttcttgacttgtttaagtgctggtaacccagggctcagtggctgaagcagctgggtgtctaaaaccccgatatctggctgccactggggttcctcctatgtgaattgtgaggtagaatgaggaagaagatctgaagtacattcctgggactttggaaattatcatattgaaaattgtactagtaaattgcaaagacaacaaataatgagtccttctctacaggcattctcagatcctggtatctctacaacacagtggatatttgaggcaggacgatggatggggccaggtgtgagagcgagaatcaagaaacctaggatcaaggagttttaccagagctttgtgtgacctcgtgcaatgtcactttaacctggatagcgtcaggtttcctcacgcataaaataagatcagatgatgccctcttggattctttgactgcaggacaatcattaggccatagtgaacagatgcgcttggttgccagaccgcgccctttgcgggtctatcaaaagggcaagcgcatattctggagctgtctcggagacttggacagaaagattcgaggcaaatattctaggctgggaaatttcgcgccgagcccccccctcagttagcctgtctaaaggctggtgtggccagagcgaggcagagagctctgcacctactgtcggggctgacaatgatttatgcgcttgtgacccacgtagaccataaacctagtttgctagacgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagccccagggccaggcaagcggccaagctgcgctctcgataaaggagccagaatggttccatctggttacaaacatatctttttattaaaaagcaatcagatcctgaagcgcttcccttgcggtttaccgctctccgcaggctgcttctccgaagccagcggtggtagcgcccactcggttgagcccacgcctccgccaggcagcgcctccgccaggcagacctcctgcgggacattttgtggccaggggggttcctgcccagggacctctaatagggtcggtggaagctaatttgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgccattcctctccagctcccgagccccactcccacccttgccgttgaaactgtgaaaaagccgccaaagtttgggcacccagcctggcagtcggaagacagtgagataaagaatgcgatagtaagtccttaagtgcttcctagagataaggtcccggaatcctggaaaaattcagtctggcctccctacttcagcaagtcgcctcctgcttctgtcagccccctccccacacacacctggagggagaggcggtggccacaggggtagctggggcagaccctccgctcctccactcccggtggccaggggtcctaaggccacgcggctggctttcttctctgggaatcaggagatgataatgagaaaatccctcaaccattggcgcgacgaaactcaaaaatggacagccctcccttattcataaatattacttcaaatatgttaaagacgttaagtaatttttagtctctttagaatttccaacgctatagtttattatgacagataaggtttgatttgtgctagtcgcgtgccaggacactgaaggtgaaaagaaggaaaacaagaaagagtttctaaaagaatacacgtaacatttaagataactacatacaaagtgctcacttaatttctcttaaaacagttacaatgaataaattacatttccaacttaataaaatttaattctcttagtcgtttgtacaattgatggcctttggttataaaattttactttttggagaaatattgcccctctgtcaaattatagcacatgacaaataatatagcaaataataggtttgacttttaaacatacacagttatttgaaacaaaatgtttttaactttctggcagcataggcaaaacagtaaaagcacagttatattttaggaattatcttaatacattcccctctatgatatcagaacttactcctgattgaaccaaggaagaacagctaactcttcggataaaacaattttttctccttcattcccaggcatggtttggaaagcaataaatgcatatttgcaagaagtcatgaaaaatcaagattaaaaatactgtataatcttcctggtaaaacatatatacattttatatctgaccatatgaaactgtcatctataagtattacattttaatgaagcataactcctcatgatatatttatttcataacaaatggcaaaggtaatattacttatcttcaagtattttttcttttaaaagctcctcccaccaaatgagagacctctatttaaacagcaacttctattgaaatatatgatctgaaggaattcgctatttgaaagtcttttgacagctttacagattatatctgttgagttttttctctctctcttatttccacaatttacatgtgtgaatatatgggtaaccctcactaacttttcaacatcagtcacgcacattaggtagaaaaaattaattttgaaactattctttgtttttaaaatgatatatgtcattactgttaggtgagtaagctaagtgtgtttttttggaaggggaaggtaggttaatcacaatgatagagcaaatataaatagtattatgttgttggtgttaaaaggcaaaacctcttagtctgtgaagatcacctacttaccttctctccattaaaaaaagagttgaactttttggctccctgtataatgtgtgttctccatagattttatactaaatattaatattaagattatagagctaacctttttctaatgtcaaagagcttttgaacaatacaggcacaagagagaaaagacacctacctcatacattcacatcccaaatttcctatctccaatgcaacaggaataatctttttattccattaaaatggtcactaaccttataataataaaggcatgttttaatctcttacctgaaggagtcttatcaatgtaacaagaactgaaattgtgactggtccttgttgtcgtttacagtacagagatctgtactgtattgcctttgtggagggctgaagtaacaacatatgactactgcctcctgagacccttatgaaaataagatatatagctggttcaaataaatgttttaggccttgacccaggaatataattgagaaaaacaaattatttcacatacactaaaacataattaaaatgttattctaagctttgcttttgtgtgttatgttgtatgtgcatactaatgttatcctcaatcataaagctatgtaagaaatgattgtacttttaaaaatgttacgtaaacatcttttttcctaaaagtggcaaaaattaccttagaaagcagttacagtgcaactttcacttttaaaggttttcaagattgaatattttaattcataacatatttctcattgttaaaattctttggcttcctcatatctggcatttaaaatttttcagttgttttgtagactatgtatgtaaggttgcatttttcactgtcaacataaagttattgtttgctttggatttaatatgtatttggatatgtatgcatatttgtttaaaactatgaactctggggagggttttaattctatgcaacataagtcagttttatataatgaatatatacaacttcagctaataaaaagtaagattttaatcttgacaatatattcctaaaatgcattaagatattgtcaatctaaaatgagcttgatttgagaacaaaaagaataagttcttttaatgaactagtggtatattgttatatgtatatatgttttgctgattttagcaagaaaatggaaaataatccataagaaaatggaaaataatcctcctgcaaaagaaacctgaagtggattacctaataaattgttttcagcctgaattttaaggtatcacgacatagtcatgtttgttttttaaaatatcattttcaaaaatcaaagacattaatggtattctctatttcaaaactatgatcattattctgctttttgccaccaatatttatgctaggagaaacatgtttaagagtcatcaacaccttgggctcattgaccatacgaatgagtcacatggtcaaaatgaataaaatgttatttagaaaaaggaaaaatatatatatatatttatacatatgcataggtattctttttaaatgaataaaagggcttcataatttgggacagcagaaaaagggagtagcaagcatcacagcccaaagcaagaatgaaagtagcaatggtgtctagacaaaggagcaaggatatttgcttttacagttagttttatttgggatatcttggaagaaagaagggtaggctctcaatggctaaattaaattatctggatgatttgtctacacagagcaataatgacatctctttttgttgttgtttgcttttgttttgttttttgtttgtttgtttggagacagagtctcactctgttgaccagactggagttgcccgggctggagtgcagtggcatgatctcggctcactgcagcctccacttcacggattcaagagattctcctgcctcagccttctgagtagctgggattaaaggtgcccaccaccacaccagctaattttggtgtttctagtagagacaggggtttcaccattttggccaggctggtcttgaactcctgacttcaagtgatccgcctgccttggcctcccaaaatgcagagattagaggcctgagccaccgcgcccggctcctcttcctgatgtgctatgtagatacatctctaacaggaaactatagatcccccagcatttgcttttgaaataattcaaaactttcatttcagttaggaaacacattttgccaacatcatattgtctatcttttccattacattccccataacaatagtttttaaatgaagtatgcctcaacttaatgtttattattaatgtaacaactatttgttgactgtttactacaattctcggagcaccaatgactaaaacaaacaaaataaccttcccttggtagagttggggaacttttccgcagagcatggaaattaaggggaaaaatcctgtaggtttcaggttatccactaggtggcaaggtgtgcaaaagtgactgcctattgcagagcaaaatttggtacaaagaatgtggctttctatgaaaatttccaccatattttgtttgtaatgatatttgtaaagtctctttttgagctctacagttaatagctaacggtcaggattcactctgtgttcagttttacaaagcattctttgcttggggctcatctcttcaagaagagagccagctgtgttccctagtggcccatctacaagatcccccagcttaccttaagagatttttctcttttcctccctatatttctctgtgcccccagatgtgtggattatgaaatctgcctaagggtctgaacatctggctttgcagaaggaccacaaagcgttggttcaattttattcaaatttacctagatcaatttagatatcacactttgatttgctgatgtggggggttagtgtccaaaacactaacatcttacaataacatccatgctgataagtagtcaaacacatatgcccatatgtacatacatgcaattatgaatatattttattttcagagactacttaagtgagatctcacatttatagcaaagaaataaaattatttcatttaatcagacctcttctttggaaaagaattgtgatatttttctcagtgaaattgggcctttatgcatgtattttgttttcagagaccatttaagtgagatctcacatttatagcaaagaaacacaattacttcatttaatcacaccttttctttggtaaagaattgtgttctttctctcaatgaaattggatctttatgcatctttagatctcccaaagagattaaagaaaaaaaatctttccgtctttgaaaaatggtttatacaggatgtagaacacttgtagggttgtttaaatatagagtttgagatttttctgtgcttgtctaacatatgaaatctgtatctttgttttcagatgagtagcctctaatccaaaagtgagatattagctaggcatggtggcactcaccagtagtcccagctacttgagaggccaaggtaggaggactgcttgagccctggaggtcaagagcagcctgggaagcatagcaagaccccactctctaaaaatacataaataaagtgagattttagagataaatatttttctttgtgaaaatgttctccccaacaagactgtgtgtctaaggacataattattagtaaaacattaacattttaatgtttatagctgaaatttttctccttagatattcactttggctgtgataattctcaacacattcaaaatgtgtgcctcatagcagagtttatacatttggccatgagttttgataacagctgtgaataagcaaaggatatattattttatacataaattggaaatatgggttgtttctgatagatgtggttgttttccatttatcagagttgtagggaagctatttttcgaagttagggaaaaacttttaagtcaggctcaattcctctcaatacacaatcaagcaccaatttatatctgttctgcttagctcagggccttccacatagttcaattaacaaatttactgattgataactacaatttgtttcatggagaagtcattcatacaaaatgtatttatagatcataatgtaatcaagccaaggtattactagtaaaaaaaaaatccattcttaatacaattttaaatgtaaagggattttaccttcagttagtttaaacaaaggaataaatctcacccaccctccccccaaccctcactgcaataattctgctttgggtttcaggacctagaaatagagcttttagtgtttttatttttaattcccattacaaaatatgtcaactttttaatgactttattatgatgaaattctattctggattactatcattttaggcttttctcatagacttactgtcttttacgagaattttactttttagttcacaatagtatgacaagcagagcagaactcaataaaattttttaaaaccacaaatttctcaataactcctcaatacatcaaagttttcatgtaaccatattttctactcaaaattttcaatatacattttcttcataattataattattgtaaacattttatttagggtttttacttcatatgttattataaacagttatcttatccttaactagtttttatatttatctagattaatggctaaactcccttgcatttctttctaagcattatccttcccagtgttcctcatttcagtaaagggcactagcagctgtccggtttttaaagccaaaaatccaggagttctcaggccctcccttctcctcccctcccctcccctcccctcccctcccctcccctcccctcccctcccttcccctctcctcccctcccctctcctcccctctcctcccctctcctcccctctcctcccctcccctcccctctcctcttttctcccctcccctcctctcccctcctctctcctcttttctcccctcccctcccctcttctcccctcccctcccctcccgtctcctcccctcttttctctctctctctctctctctctctcgcgatatatatatatatatttatttttgagacacagtcttcctttgtcgcccaggctggggtgcagtagtgtgatctcagctcactgcaccctcaatctcccgggctcaagcaatcctcccgcctcaacctcccgactagctgggaccacaggtgtgcactaccacaaccagctcatttttatatttttattttttgtagagatgggggtctcactatgttgcccagcctggtcttgaactcctgggctcaagcaattctcccacctcggcctcccaaaggcctgggattacaggcatgagccatggcaccatctcagttctctgtatctccactgccgccacccagttctaagccttcatgaccttccatctgaacagcctcagatgcctgctaactggactccgggctttcactcttgctccagcctattacccgctcttcacgcagcagtcaggaatgattgttttaaaaacatacatcacatcacatgactcctcttttaaaatctttctgtaatgttttattgcccttgaaatagaattcagattctttgctactacctaccaggccctgccagatacggcttctgcctttttttttttttttccaaacccatctccctctgtgagttccttccttcctcacatatttcctgacctttatcatgttttagtggcttttttaggtgctgggaatggagaagtgaatataacagtgtcttctttcatggcgcttacattttatggtgcatggaccaatgttgtttctgcctcccgggctcagcctttactgctcctctgctttggaaagcacttatcctctcagggctgcaaagacagagcgagattaatcagtagatccaggactcgctagcctgtgacctctataaatggtcatgtttatctcctcagagcatacttctgcaggctaaataaattaaataatacaaagcccttagcacaataaatgtaagataaatatgatctataatttggatttttattatcagttttgcaaagaaatatttctacaactttttcagagatttctgagacttgcttccttatggcattgaccaaactgcaaaatgagctcccctgcaggaattttgagctacaaaatacattcccaagaagctggaaaagtatttcctcccagagccagggctctgctgtgcagcataatacaaatatcccaagcttaacgccatggtttttatcatggatgctgattagaacataatttagtgatgtttttgattggaaacaaattttgaccccatggtgcgttacattcaaaatgtctccattgcaaagtgtttaaacttttattattgcatttatcacattgtattatagtcgtgggtagggtaaccacacatcctaagtttatgccttttgtcctgaagtaccatctggtttagcattttagcactctcaaaagtgtcctggtttagacaataaactctatagtcccccaattatgaggcaggtgcctggctgcagaggctgaggagcactggggtggtcctaagctaagtgtgggtctgtttgagaaattggtgatgctggtgacccagagatgtctgcttgttttgcatgcagagaagggcatagaggagaaacttaggcaccgagggccaagggcagaatcagtggaggagagtaaggagggtctccaagactacacctaaactctagaagaagagggctcctcttctcatttctgctaagaacacaacacattctaaggcagtgaggatggaagagaacagcttcgttttggttcttttgaggcttgtagttgtattataagacagcaaggaatcaagggcaatgagacaaaacttagaagatgccttgcaatcctaaacctcagtgaagtgtgaaaacaactaaacctgggtttctgaggactagaagaaacatttggggttggctgaggattgggtttgcatgcatcttaatcaccagagtaagatataatttggtttggtttcatgctaaagttttagttttcggtacttcgaattaaagggtcagatacagtctgtcagctaaaaaagaatatttgttaagtagaatacttcatgtcctggcaggaggaaacctttctgaacagagtgcaccttggttatttagtttaaaatttttattctggaagattgtttaaattgagacaggatggtaactttttatatacaaggaatgttattaaagtactttgagatttttggatgcttgatttgagagcacttgtcaaaatcaatttgttcatacaacacgtatttagatcctacagcttgccatgcactgtgctaagtgctcatgacaatatcacaatgcatatcaactcctctagtttcttctgctatgtctatgctgaggactctcccagaacagtatcttagcctttatctcccatcttaacactatacaactaacagctgaataccttcacataattgtcttatgaatacttcaaattgaccacagtgaactcattctcacctgcttacatcctccccatcatcactaccttcctcccaacccaagaagacgtgtccttcactgacattccctccatctagaatagaactccttcttcagagtatttggagtagtttttaacttcttcatcttcacgtccaacagccagtagtacaccaaaatggtttacttcaaaagtttatctcaaatcttgcttctatcacttctactcccaatgacagtactaaagttcagatttccattgtatttcacttgcgtaattatagtagcctcttcactaatttccttagactacagtctattgcatttctacttcatgtattagagagatctttctgaaacacagatcagaaatgatacttttcttcttgaaaaatatccaattgcctacacaataaagtactgactctctattttagcttactgtctgttcaaactatattttccaggcttttcttccacatcactcccactttaccctccaactctagcagattattcactatttcatgacccttatatgcttttggttccatgcctttgatcatgttattaactcagtcggtaatatacctactgaaatagcattcattctttcacactaagccagttggtattaattgcttactctactctttctaaaatactagtacttttttaaaaagatcttttaacatcgtttcttctgctattcattaaggttagtaataaacaaaaggcacatgggagtcagtgtttgtcttggtccctataaatggtcatgtgatcctccaaaagtcacgtaactcctccagacctctgaaaaattgtggtgatactatatatgaagtattacagaactgtatgtgatgtattatggttgccttcctcccactgaagtccttaataatgaggggtagttttcttcatttttgtctctttcacaacacctagtaagttcctttcttgcacaacataagccatctttaaatgcttatttaaatattaaaaattaaaatgtcactgtaatataaaataatgctctaaatttatcgttgtatcataggtacttaggggttatggtaaatttgaacttgaatatgtgagaaatgatatttcccttaaacagtgagaaaagcacaaagtacatcagaatgatgttggaacagcaggtcttgcctgtaacgtgattggctacattaagactttaataaattgatgtaataataagtggaagtattagaaacattctgagtcaaagaaaggggaaactgatgaaagaaagggcaaaacaccatgctacttagtataaaattaaaagcaatatgggagcaattcttggcagtttctagtagaaagtgatttcagctatcaaattttaaatgtgcaaaatgatctctattgaggagtgcatttggctatttaagtctgatgcaaaacacaaagcatttgattcaggtaactccccttgatcggactccatgcccatcaatcaatttactgtaggctggtaaacagagagagagaaggtgctgatcacatttagtaggttatcactgtaacatttcctttagttctggatttaaaatcatgtcatgaaaaatacacgtgcttgaggggtgctgacaaaaccagatttctgaggctaagaaccagacccagaaccaatacaaatccatcatggtaataaatgccactctgggagagctgttacaaggcattgaatttcacctaatccaatataagcttggtttcattcaagtttttcatttctctggcttattattgacaatggtcataatcttttttggatggcatccaggaaaatactatatattatagtaccaagattaattaaaggaaggagagaaatacatatttttagaatttatgctgtaagaacaaaaaactccaaagggaaagaaaatgaataactatgaactcctttgcaaacacaattgcctaaattagactttgcaatcagtttttagggaaaaatatgtatttctctccttcccttaatttcacaaacattgagaaaataaaatatataattgttgagaattatagagatacaataaactattcaatggctgcaagactgaaaatgacatgggctttggaagaaactcactggagggcaatgtgatgggtgtcactgtgctagtatatacacggagctactttacttagctccttttattgtcctctctaaaagggcagcagctttgataaacttttctgggccaccccacttttctcagactgcctaccacaggagcacaggcagatattcactggaactctggccctggcaaaaggtaatttccctttgggaacatatattcatgcagctcagaggagacaactaccctcaacttgttcaagatgagggcactctttgttcattttttgtttagataaaaattggcaaatacacattaagtttctgtaaaaggagctactggatgtcttgttatatcaagacattttctatgaggatttttttggaagaattttctctggcttgaattcttttggacaggttttgaaataaaatgataaacactggtattggtaattgctacaaatacaaataacaatttgtacaattgttattgtaatttggtattggtattgtttttggaattagcaattgacatttggtgtttaattggtattaacatttacttaactttcagttaaacacaaatgtcaaatacaacaatttgtacaatactaaatacaatatcagtattgaagcaaaaatatatattccatttgccacctagtaactaggtatattcagcaatttgagtttagctaatgtcatcatttttaaacaatacatacataaataagggtgtattaagtcatattgcaaccttataccttaatttaaaaacttgattataaaattagtcatgcttgttttttaaaagtattttgaacaatgaaaaatgattttacttttaaaaaaatgcttcactttaattctttaagttaaaaaatagaatgtaacctgagatcctaaaattccttgtttattttaatttttaaaacaaattgagaggggacattagtacagattttgtcttcaaagtttcctttagaaaatgtcaacaacttaaatatttaaaaagtgattaactacttgcaaagagactaaaaacaatatcttaagtatgtgagtccccaaacatacatatttctgatttagacttttaaactgtcaataccagagagacaacgccactgatggggacctggcactagtccttccagttaattttttccttggagaatggttttgggcgacagagtggcgtccggcttcccaggttgttgcactgacaaactgcagtggtggcaaagtcaaggagtctgacaaaatctcattaatcattttaaattaaatccaaccttcctgtccaaccatgccaggaagaaagcctttattttttttttaacaaataaaaatttcctcagtaaagatttgatatctttctcttgttggtctttaatttgatgagacaaaaataaaataaaacaatgtacatttttaagcttgaaaacaaaacatttgtccagataatgatttaacaggtcaactaagtgtctttttaaaataaattttgaataaaaatacatggaaacattctgaagggaaagcctactaggtaaattagggacattgttcatattctgaatagtttgattaatttattttgttctatctaaaatatatgatccttaagaagattttaaagaggaaatacacaaaaaatccactatctataatattttggtatattttatgccagtctcttctttgtattcacaggtttttgctttgttttatataataattgtaatttgtgtatatatatgtacaatacacacatgtacaattttatatactttataatatctgtaagaattttcccatattattgataaatatcattgcatcatagtaatacatcatgaggatgtattttggtcttctcaaccagtgcttagcatagtgtctggtacatagaatgtactcgaatatttgttgggtatttgttagaatttcagtgtttccatctcttttttcttttaaaaactgatgtaattaaagttgtgcatattgccttttcccaatttggaattatttccttaagatgactttctagaagaagacacattcacttatgaatgcttgacaagaaactgtaggcaatagtgttattaataatgatatttaggaaaaagttcacttttgacacaggaaaacaggttttaatttgaataaacaagttgttattttaaatattaaagcttatgaataagcttactctcattgagcacaatattcataatattgtcaaaaacttagaccaattaaaagaagtaacaagatcaatgacaaactcttgatgtttttcttatttttaaaaaaggtcaccgagtctgcacgaaaaaaagtaggtaggcaatctccaagtagcaataactcattcagatagttcaaattatttctggagaggtgaatttatgtctagaataatacacagttgaatcttaatattttttaaaagttagctaatatactctggtttgtaaattgtgaaaggtctggatgtattttttaaaaatggaaatagtaaagccatatttctatgtgattatatagaatctaaaccagagcaaaaatgattcaactggatttattgagaaactactctgggctaacatctgtgttaggcactgagtgagatacaagaacaaaatttccacctgcaagaattaagaaagttgtcctggaggggaaagaatctaacaggacttggaaggacaaataacattcaacaggtaaatatgaagaaaggttaacagctttcccgaagagaaacacagtgcaaatgaatggaaatatgaaaatacagatttttatgaaaatacaaattcatcaagattagagagtgctaattttaaaagaatgtattcagtaaaaaccctattgatgacaaatttggagggaattctaaaagttgttaagcatttttgttctttcctctcttcttcttttcattttctttttccttcctagtaggacaccaactaggaaacactgaattgctaatttggtaaacatttactaaatgtttataattaaggtttttcatagatagaacatgttaaaaatttctactcacctagttttaaaaataatcaggaacaaatccctactcagtaatcataggaagtagaaaaagaatactacccaattggagagggttccacttcaagtgatggtcaagaagttctttcagaccaacctgccaacatatgaaattacaaactctggacaaaatatttaaaaattaactaactgaaagtaatagaaaacaaccaaaagcaggttgatcctacagaggagtgaatacttagaagaaatagcactgggtgagtttcctatttttatagttcatagcctgaggaactcctcactctgcatcatgtggagactacagttgtattgacttgaagaacactaggacacgtttggggtaatggcaactgctggaaaacgcagagggaaatcctgatacgaaaagaaccacagagagagccctaaattctgtgtatgactctgctaaagctggctggtctcccacgcatgcatgtacagaagagatttcaagtacaatagccaggttaaaaagctgaactaaaatctgagctgccacgaactctaggggaaccagagcttgcagctggcagtttggccaagttaactagctgctttaaaaaaaaaaaaaaaaaaaaaaaaaaagaagcctttagagaaacaaataaaaatccagggtttctgcaacattttacttaccatgttccagacacaatctaaattactctacatatgaagaaacaggaaaatgtaacccattctcgaaagaaaagaaaattagagaagactgacaatgaaatgatccagaatattgaaatgaatattgaatatattcatacattaaaataagaattttgaaaattgaatattgaaatatccaatactgaaatattgaatattaaaatactaaatattaaaatagacaagtatttaatattgaaatagaatactgaaatgagccatcaagtatcttagctattataactatgctaaaaggtgtaaggaaaaatacaccagtcatgaatgaaaagataatctcagcacagaaatataaattataaaaactaaatagaatttctagaactaaaacatacaataattagaataaaagttcactgaatgggcttaaaagaaaatgagtacagaagagtcagtgagttggactatacaaatcaagtgaaaaaaatccaattgaagaaaaaagagaaaaaaagggatgaaaaaccaagagcttcaaaaacctgtgagacaatatcgaaaggtctagcatattcataaatgcagtcccaggaggagaagagaaaatgagattgaaaaacaatatttgatgaaataaagcactcagaggaaaattacatttgttcacaagggaaaaactatttgaacactactcttctcattggaaacaatggaggtcaggaaactggaacaatatccttaaaatgccaaacgtggggtggggggaagttaatctagaattatgtattcagcaaaaatattcctcaggaaggaaaacaaaataaagacattttcagattttaaaatttgtcatacttaatttccagcagatctgaactatagatgttaaagtttttcagtttgaaaggaaagatgctacaaggaaacttggatttttcaggaagaaatagagcatcagaaatgataatttgggtaaatataaaagagcatttttttaaatttaaaatatatatgtctgttcaaagaaaattataacattatattgtggagtttataacatatacgtaatacatttaataagataatggatggggtgatagggtaaagaggcttacatggttgtaagttttcgatgtttcatgttatatagtacaatattatctgtaaataggctgtaaagttgtatattttgaactgggtttgctttgcccaggtatacatgcatttgcggagactcattgattagtacacataaattttacctcaaacaaaaaagctggcctggcacggtggctcatgcctgtaattccaacactttgggaggccgagatgggtggcccataaggtcaggagattgagaccatcctggttaagcaagaaatgtggtcttactatgttgcccaggctggtctgaaactcctgggctcaagcagttctcccaccttggcctcccaaagtgctggaattacaggcttgagccactgtgcctggcctggttaacacggtgaaaccccatctctattaataatacaaaaaattagctgggcgtggtggcacgtgcctgcagtcccagctgcttgggaggctgaggcaggagaatcgcttgaacctgggaggcggaagttgcagtgagccaagatcgcaccactggactccagcctgggcagcagagggagactctgtctcaaaaaaaaaaaaaaaaaaaaaagctaaaaaaatgatctctagctaatgatttgcaagtttaattaagtctttaggaaggaagttacgtctcaaacttatttttagctgtatcaaaataattgatggatagaggaatagataaacatgatttagtgaatacagtaaaattttaattgtagaatctaggtggtgagtaggcattctctgcaaaataattccacttttctattttaaaatttattttatttttaaattttattgacacagggtctcactgttgcctaggctggagtgcagtggcaatcacagctcactgcaatctcgaactcctgggctcaggccatcctcctgcctcagcctcctgagtagctaggactacggacaggtatgtaccaccacgcctggctaattttttagttttaagtagaaacgtggtcttgccatgttgcccaggctggtctgaaactcctgggttcaagcaaacctcccaccttggcctcccaaagtgctgggattacaggcatgagccactgtgcctggccccacttttctatgtgtttgaaatattcctaagaaaatgttggaaaaggaaatattgccaatccacatttataatcaagtcagggtagaaaaataaaataggaaaaagaaaaaaagttaggaaattgaggatacaaaaaaaggaaaagatataagctaaaacagaagcagagagaactggatggtaagagacaggtatgaagaaaaacaaagaaggaaagacagaaggaggtagacagagggagagggcaaagtgttaatcactgaaaactaggcatgatagtaaataatagttatcaccaccctttgtcttttgaaatgtaataaagcagttttgaagttaaaaattagaattgtcatggaattcaaaattgtgcacatgcaaaaatgatttggatatttgcttcagaatcttagaaattatttactatcagtctaaaagtcccttagacattcaaaatttgattatcgtatgtcttgtccttgaaaaatctgtagtacaacattccagttgtaatattgacaaccacttttgactaagggtcagatctggaaggaagccaggattcaatacctctagtaaggagtttttacctccctcaactccctcctctaaactagtagctcaacccatcacatactatttcattcctaaggttatgctttttacttggaggtcacttttaacttaccatataactacactgttctctatcattctaatgctgcatattttaactattaaataattgttaattaagatatacttcatatagttgctctccattcagcagattttttcttctcagtacccagttatgtattatctgtgagagcagggcccatgtctagtacctcgcacaatgttaacacatgtaaagccctggatagacattcactgaaccaatgagtaaagagtgtttactgttcttcacaatatgtctttctcaatggactctgaacggggatcatcaagattacaaaaatagtaaagtttgcataatcacaccacatataagcaagcaaacatttaccagagttctaataatattttattttattcctatgaatgtaaatcataaattttgatgttttaaaaatcctaaatggtttaaaggacttaccgagacttgattaacccagtttttaaaataaaaaatcaaattataaatttatattataaaaataactgccagttttgcatagtaatatagtaacaaatcaacactcttcaaagtttaaaggaaaaggaagctggtattggtttctgtctgaagtcagatctaacttttacgaagacaatagtttcagatcagaatcaaataaatttcagaactcagtttgagagaaaaggaaaaactttagttaaaatctttacaataaaataattatgactataaatctctttagttaaatatgtacacattacatggtatttgtataaagaatggaaatggataaagtttttcaggcaaatctaatgcacaaatacaccatcttttagagtataatgtcagtttatcattcgttaacagctgtgttagacagtggctctgctttgtgcaaaacgtgataaacaaaattaggaaaaattctgcaaaattatttagttccccaaggaaattactaaaatagaaaatggcaaaagaaaaaaaggttgcacactgaagcttgattgtatactcaggctacaatgaccagcactgatgtaacccccatatctgctaagtccttgggtagctttagtctgaagtaaaaactgaagtcctagcaattgtgctttttatgcagccacatggccaataaggtagatattgtcataaagatgccctacaaaatcttcactaatattttgagcagcgcgacgggtatttcgaataaattccctttttgacattttattcttcacatgagggctagtgaggtcaatggaaagtagaatcaaagagtagcacagtacatagacagcatctggaaagaaaaagaaacagttcaaattattagttggtttacaaaatatgattccaatggcattatataaggcaaaaatgttcataatttcaagatatcaagattagctcataaatacagagtgaccaatccatcccagtttgtctagactcttcccagttttgcactgaaagtcctgtcatcctgggaaactcaatcctgagcaaaccaggatggttatcatcctatcttaatactaactaagcatgcatttccttcatttcaaaagaactttagaacagtttaggagtgtatagtaaaaattcattctagatttaaaaaatttagaattggctttattttcgtctttgctttcaaatgtgatatttctattcaaacatccataaaatacatttgtatttatctcctctttctaaaaaaaaatttatatagaatgctttcataaaaacctattttaatttgagagcatctttaatgacaagaaaacatgaatctggtactagaaaataaaatgtaaataactcaaaagattattaatattctcatttaagatgttataaaggcctgtggaacttacatattaattttgaaagcaaatctttagggaaaagactgctacacctgagcaccatgcaacaagattttatatatgcctagggtaatatttgatgtttaatattaaaatagtaacaatcgtcataatagttctactactatagtgctgatatttcggaatcctgcagtcttaagaaagccaagttgaacattatgtcttgtaaagcatgctcaacaaatttcacacgacaggaacagttttgtaatttctgtttaatcagataagcacaataaaatttttgatatgaaaagataagctatatgaattgaaacaatatgtagaagattcaggctatatcataagcatacaaacatacacatatagatagaagtacacacaaacagacatatataacaactttatatatatacaaatgtctatatgtctatatgtgtatatagacatagacacagtctatgtgtatgtctatatgtgtatatagacatagacatttgtatacatataaatttgtaatatatatatttatatataaatttgtaggtaatatataaaaaatataaatggctatatatacatagccatgtatatatatatatacacacacacacacacacacacgcacaccatagctatgacaaactgttttttccaagctcccataaatgatgaagtagtcagtcactgctacaaacagtaaaacaagtatttgtaattactgagaatatttttccccacagtgagacaaatgtctcatatatctctgtttttacctaaagatgggcagggggtgatgtactattaatatatatattcttaccaggactaaggccaagttctcgcattaaatcagggttgcaagcacagaatctatgtgagaactttgttataagagtttcaagatactctccacgctcttcaggggcatggatatgacgaaaaaattctctcagtgcatttggcaagaactgatttctaaaattatgcaatgttacaaggtcatccaagacatctctcctacagaaagaaaaaaaggcacagctttggttaacttttcttcattaaaaaaatggtaagaaaaataacaaatttccattttttggataaaataccttattactgattactagatcagctaatcctataaaagtatatataattcccaacattaaaaaatctaagtatgattatttaagaagttaactttgaaatctctcatgagtagtttatgacaaaatgaaacaaggtaaaacctagtaattttacttctaaaatgaagaaaaaaggaattctgcagtattaaaatgaacaatttctttttaagtgccttcttggccaaatccaaatagcaatagaattgtttatttttcaaattatgaaagtaatgacagtctccacctataccaattcacatcttcagaggtaaaaactatttacatagacttttaagaatgcctacatatgctatatattgttttataatttgtttttgcttttttcacatagtatattgtggacagctttgtatatctttatacctagatccacctaatttatttttaatggcacagtatcctgtctaatggatgcaacaatcctattgatatacatttagcttatttgctataatataaatatatgtgtgtgtatatctaattttttaaaaaaatcactagcatttcaatatagagtcacactttgttacaatgtccttcaattcttattgaactcaatcatgattttatgatcaaatcttcaacttctaccaattgcatataacaggaacaggcgaactacagctactgggccagatctggcctgctgcctgcttttgtaaatacagcttattagaacacatccacactactttatgtattgtctatatctgctttcaccacagaatggcagagttttaagtagctgtgacaaagatcatatgacccacaaaacctaaaatatttacaaaaaaaaaaaaaaagaagaaagaaagaaaaagaaaagaaagaaaaaaacccctgcctatccctaggtacttggcacttaaagacaaaaaaacttaatgatgcgatctttacatctttcaatgaccaggatgctggactctgaacttctcaaagacagggactgtatcttaatcatccgtgtgctactactctagcaaagtttctggaatataatgaatatttacagattgctgttgaaaaatactgatatatacaaaagtttgagaattacaatgaaggtaaactatttttaagccatacattacattagcacgagagctataattttaaaaatggtagttcagttatgtggcatcaaaatgttgtccccaaatttatgttctttaataatcaaaagtaaagtgtacaaatgaataactatcaaatcagaacagcatactaaccatcatctctgtgtaaaactgctaaatgttacattttcataattttcacacttgaacataacatttctatatagtgtctacatgcaaatatatataccttatatccctaggatttggggtttatgactataatctgtctttgtactaggttttttatatggataatttcataattcagaatttttaccactataaacacttagattatggctacttgtcttaaaaaatcagggttgcagattcctgaaaaatattttgttttggtttgctattacaaagacgttgggcttccattttgtgtacatgtggacttttacttacttttaaaatggtaacttcctcatcaacaagtcaaagctcacgaaagaaatgatgtgtgagatataggaatcttttccctgtctttattcaattttgcaaccagatgattactatgcagtattagttttaaagtaaaacttaactcatcaaaaacattacttaactcattttggatgaaaagttaattttcgtttttacctttcatcaagatagattctcagttttttccaatttagtgttcttgtacagaagataaactttgctatttcctttggcgaatcatccaggatacccttggacataaagtagttcactccctaaggcagaaagacaagtctacataaataaaattgctctttatttatgcattttaacaattaagcaatagcacaacagtagctataaattctttccagcattaatagactttttgtagctttatcatgcaaaatacaagctagaacttgaactgaaactattgtttgtggttgatagtttacatgcaatgaaaagcaggaaattcaaagttaagactgttaaagaaatcttatttaattttctggctcatgtcaggtaaaactaactatacagaaatacggcctaatttggggaagggggctgcagatgaaaccacaatacagacgttaaaacaagccttttaacaaacacttctgctgtctaatacaaaacatgatttcttaaagctcacatatatattgcagtatgcctttcaaggaaagagcttcttgataaaaaaatgctccaaatgaaagactagcaattttattctgggagaaaaatattaaattatttaacttaaagtaaaggaagcccaactccaaaccaatgtataggttgtactactttggctttaaacattgctatgttctacaaaaacctagctacaatacacactgagggaaaacatagtaagacaaaacaattcaatgtttttcatagaatttatctttgaatttccttttctctgcatgcaaagttttccagagaagcattacccataagtttttacctactttagatttaaaccaccaccaacaaaacaccaccaacaaaaaaatcaaatgctgaaaacagtattctctcacatatacagaggttacattcaaataaatgtcttcgctggatttgaatgtgcagttattgaaataaaaggcaggtgggtttatttcaacttgcggttatccagatacatgcattcccatgaatacttatgtctggatactagcacactatgtgccgttaattggcagagaaaatgacgtattatatacacacaacataatgttttcacacataaattcctttggcatttcttcactttacaaacacttacatagtactcagaaatattacacacattaagaattttaaaagttggaagaatatctataaaaaccttttcaagataaaaactttctcataaaacttttatggtaaaaattttttttaagtaattaggtaccacgaggtaatgcttttgaaaggttataattatctataagttgtaattcaaagatcagactttttatataaaactaactttatgagccatcaacataatagcctactagcaattcgatcaaattttcatgtgaattttaataatacaaaagcaatgctaaggcactgattttaaaaatgtacatgaagaaaagaacgtgataacgtgaaactttcttgtcaactctgttgtaacctgtatttcagactaaatcctgaatacaagggctagaaaatgtaatatgataagatggaaagccaaaatacttctttggaatgaggctttcatcaactgtccgagggggcagcaactagaaaactgttaatgcttgttctatcctttcctccattagtttgaataatcgagagttgactgtatactcaatctgcttagcaaaagtcaggtttgtttccaaaattcctcagtgtaaaaggataacaatattttagaattatttccagtatttaattttaattgaaatgatttaaaaacaatgtcaattaagcattatttaatagattctttattcatacctaaatcagtatctgagatgtagaactaatgctaagctactttttaaaaattgtgcaaaataaacaaacctactaatagtatacattaatgatatctaattctctagttacataatctatgccactttaatatcatttggtgatagttataaattaacactggtatttgcctcatgtaaacatcataaaaatacactgttagccatattctgttttataaaaaacacattttgagaattttatatctaatctaacctcagttctcccaaatcaatcaaatacatagaagcagtcatgagcacaaagaattttaaattcaatcctgaaaattgggaacatagattgaaataagccaactctattggttttatgaggaaaagaggcatcaggttcaagcttgggattcctttggagaggaaggttactttagaagggctaccaaagtgaatggtaaaggaataacaaatacaaaaagacatgagaacagattataactgtctctaataagcaagctgtaagtcacccaaattcttatcttcttatgtattaggttggtgcgaaagtgattgcggtttttgccattaaaagtaatgtcaaaaaaccgcaatcactttcgcaccaacgtacaattaaatacaaaaaaataccacagcatgaggtctgttgaataactacatatttgtttagtaagtggtataaacatttttaaaaataaaattttagaagaatggtacagagaaactcctagaccacatagcatatcagtgactagtcaggactagaactctgagcagtgtgtatgtgcatggacatctgtgcagtgtctcacatgcaaaggaaatcattagtctagatatatatatatatagtattctaaagaaggaaggttgtagctcagtatagtctacaaaattgactataaaagtttccaattttgggtgtcacattttataaggcatactgacaaattaggacttatctggataaaggaaatcaagacctggtgagatcgttgaaggctgtagaattcatgttatgtaagaaagagcggagggacataggagtattaggccagagaagaagatatacttaggaaagaagaaaagattaagactttaggatatctaaaagactgtgtcacaaggaaaaaggaaaagatgtgtgtggttgtagtgaagatattaagctcttttggggggctatggacccttttgagtactaggaaagtcacagaacttcttcccagaataatgcacatacacattttttaaaacagaaatagagttccatctaaggactgcaggttacaaatccttatcctagatgagtatagatgtaaagtcaggaaatctcaattataggcagacagattagtaccacataaggaagggaatgcttgtaactttagttgagctgttcaaagaccaatcatttgtctttgcttgattcaattttgttgttgttgttgttgttcttacattttcaaaataagattaagcttcaaactcagaactacttaaatttgaccgtttaatctatacacattttaactcccatttgcaactctgttcaacttttagaattatctaaattgttgcagtcataatgtagttcctttttatttgcatgtggggagaattctaagatagttttgtcagataactctgagatgaatcatgatggtgttagtactatcatgggctgaaaccatcatgattaatctcagatacctccaagcatagagatcagctcctgtcaggtgaaaggaaactactggccaaaatatatttttaaaaaatagttttaaaggatagttacagtggggtaaataaaattcctcttattaaaatagatattaggcctcatatttcttgggaaaataaactggtaaataatgtccatgctactaattaaaaatttcctagtcatttgatttttttaaaaaagtatccaattcactttacatttagatagaaagatgaatgcctataagactagcttgtaaaatagatatatgtatatctgtgcatatttacatatatgcatctgctttaaaatattttttaaaacatgaagcaatacattaaaattgtccacattttatttttgaaacatattaaacacaaggtgtgatatgcaaggtattcagtgatagacactgagtagtgtaacacagagttttgccctaagaaaatttaaagtttatctgtggcaatgagacacatacataaacatctagaatacacacgtgccaaggtacatcaataatacatggcagtagaagaaaacctaaatgaatgcttatgaaaagtaagtgtttcagagttcaatgaaaggaaaagtcactatgggataggacgtttggataaggtttcctgctagagattagactgaagtattgtaaggggtttagacaaggaatttaaggggtttagacagctctgaatgaggggaacactggagaagaatgttccagttaatactgtattatatgagcaaaagtaatatataatttttaaagactatttttaggaaggcaggggaaatattttgggttggagagtaaatgtacaaccagactatgacagtgacagaaatagtgctgaattttagggtaagaagtttattctctatcctaaatctaactggaagcctctgaaggcttttaaacctgatgaagcaatgggctataatgtgaatttggcagcaatataaagataaataatgaaagaaaaattagatagtgggctattcagcggagcactcacttaaaaaataaaaataaatagatagcgggctatacaactgtatatgttacatatatgttacatatatgaaaataacttgataaatatgctgactatcaagccatgtgacagtgaaaagtgaaagacagctgatggttctggcttagatgaagagggaaatgactgacagaaaaatgatggacaggtcaaaaaaagtcaaagagggtgttgatttgaagaaaacagtgatgagttagcttttagacatgttgaattttaggtgatgacagatataactagaaaggcatagtaggcagttggtaatgtaataggatatattttaaaagtgagggttgaagatatagattcaggatcttggataagaaggattagtaagggagtaatgaagagaatgatagaataatgttccagaagccaagagccttcgagttaaagaacagggtgtctagtgcaattatgcagtatgatggaaagagcaccatttttaggacagggaccaagccatggttctgcaacttaatgatgatatgaacataaacaatctacacaatcttcctgagcctcagtttcctaatcagtaaaaatctcagtgggctaagtgcatagcaaaaggaacacagctagttttctttttctttcaaatagctgaaggatactagaataggaagagggcactgagtttggtgactgggaggaaagaagtgactttcaagaggtctctttccacactgtagcagaggctgaaatccaagaagaaaacaaaagaatgagctcaaggtaaggaaactgagtattgtccactcacttgaaaaatatattagtacaaaggaggaaaaaatggcaaaattaaagggaaaaaagagaaagtatttttttttcaagataattatgacctactcatgttagaagacaaaaagagaggtcaatgcagacaggaaaagactgatgtgcgggagattttgctgcaggggcagcaaagccgataaaaagagagcaggggaaaggtctgaaaatactgctggagtttataatgattagcctgggggacagcacagtagcaccggctcagagacagctacagtaagaaagtgaaaagcagaaaacaaagaacatgttggtttctttcttaggtctatctggggagcattggaaaagagagggctgatttggattcttgggcaaagtggtgaagatttctatcaacaacgatgcaggatatgactggatatgactgggaattcactaggaataaactaaaggagtgccaagcagcagtgagaatctaggtgaagttaatgtgaattcagcccatctcttgttaaggttaagcaaaatctaccatacatatgttcagaatcagtaaatatatatttgggaacagagtgaattctagaaaattagacatgcaaagccaaatgaaaaagtactgataattggtactgaaagtactgtctactgccacagacacctggcacacacattgtgtaacagttggtatcaataaaagttacatgatgttttgttttgttttattggtgtcactaataaaacaaaactgtcacatactagggagtacctttaatttttttcctaaagaacaacatagtaaagaaatttagaaaaaaatttgatttagcaagttttgttcaatttcgtccttgtataaaatgtaaaatctagtacaatggccactacttttcaggtcatcaaactgcccttagaccattatataatagaaagccaattggatactgcatttaattttcttttaaaaaaacattttgaagactttaaaaatagtaatacttaaacaatatagctcaatctagatttctaacttttctttcaacatgataaccaatatattatttttcaagtatacattttaaccacagtgaaactaactgaatatattatttttcaagtatacatttgagcacaatgaaacttaaactgaaatgtaacattttcaaactgaagataatgtaaaaattaagtgacacaatatacgttattaatagtaaaaataattgacacatctgcaggtcaaatgggaacatccccattgttttgtttgcaaatagcagcagcaatggttaagatgactgctctgatactatttcttcttttctacagtgtttgaagaattgctaaggtaaatgtaaaatctattaatttttatcagtccagaagttctcattctccctatttaagcagagaacatgtgctctatagttaagggagggtgggcctcacagaatgtgaataattgacaatatttatctgaggatatttattatgcaaataaaaaatcaacaccttgctttttggctgcggtgaaataagcgcagaagatttcttaattagtatgtttaagactaggtgtctatgtttttatcctgtcatttcatttctttctacccactaaattttgtaatgttttctgctttctgtaattttccatgaccttctatgtttaacactgaccttgagcacatacataacagaaatgtcacacattgcttttattaagctgcctataaatataacaatagttattcctaatacagtcactagattcaaagactaaagtaaaatctatgcccagattttaaaagttgtcctagataaaaagattataagagtactaagttttcctctcactgaggaacccataactaggctattcaccagaaggctctgtgttacacagaactaagaggaaagggggcagtgaaaattgggaaagaaatgtaaagatagttttgatgtcagttttaagtctaaatagcagatttcagtctcctttcttccagagcaagaacagagagcacacactgtccacactgaagtgggagaattaacagctgtgaagagagagtgccagtatcctgtagccagttttctcagttagctatgaaacataataccatattttgtctggaggataatgaagagttttgattttacatttacctttcgtataatattaaaccagtttatgtataaacattgtttgaattggcaaggatttcagctagaatgatttatggaagacttttcaacatattaaagagcagaatgctgaggaactgctaaggacagagatatatacacctgaaattatctgcagttaaaagatgtcaacagaaaatcccacataaaagagtgatggtttaaggaaaatctaaataaaaataacaattccctccaatggagtccagggaaaacacagaggaggtataggacaggtcttcctgcttatttttcaagagagaaaaagcaatggcaaacaaaataacatgaacctaattttctaaagttttaaataattaaaagcccctattaattcgttctaatagcctcaaacagaaaaagaacatctgtgaattctaatatcccccaaaagaaccacattagtgactgggatggatcaatatgatagctaagaaagtatttcctaaataataaattactactatcaattaaatgtaacaatcattattgtaattattatcaaaaaagttgctgctagttgagtcacgcttcttggaaaagccccctctatctctaacctgtctctatattagaaaaagaaagcattctaatcaaaatatggagataaatctctattaggttatgattaataattgaaactaatgagaaagtgacacatttaacaatgatgctagctaatttagaattcttgctttataagaatcacatacaaatactggatttgcaatgtgcatatatacaactgtttaaatgactaacccataaatactagttttatcatattacctagatcttaatatgtacatttataaatatattttaacagctctgaaacagttttaaagtaaacaacatttttaaaaaaagtctactagtagacaagcaagttgggatttacatggtagtttcactgctagcacatgtatatacttaatcatgtaacgtaagtatctgttcatcctgccaacattgtagccaagacacatattttaattttaacataactctggacccctaattattgcttaaatgtcaaaaagattaaactcagcagcactactgaaacaaaatgttactgtatatgcaaaagattgcatatacatgtcagaaaatacaattaaagacaaagggtatcatttaaagctaggagatattgatgtgaccaatacatacttcatgaaggaccattcgtcaggtgtcatatagttatctactagaatccaaaagttcaagaagaggaagaacgtcaaggcctagaacagtgcctggttcttggtattttaagttgttgtagttgtacctttagtataaacatagagttacagtttggtgaacacttagaggcatgtttaacatgtcttatttcatttaatcttcacaagaacactgttataagtattattactgtccccattttacagatggggaaactgaagcacagaggttaaataacttgctcagagccaacattacataaattgtaagtggtagagatacttaataaatatttgttgaatgaatgtttgaatctacgtgtacaaagcttccagctgactttcaagacatgctgtaaacttccaaggattatataattcaaccaagggaaaaatacaaaaacaacccccttccataaaatgtataagctggatcaaatattagcggcagataaaaccccagcacactttgaaatacctcaagttatagattctcaaaggtcagagtcaccaatccaaataatccaaagtagcatatcactttgatgctatatttaactgctaacaaccaaaagagatttacagaaatcttaggaattttgttataaagaaggcatctctctaaaaactttatgatataaaagaagaaaacgttatatagttttatggataaatgtacactacagttagctggttttaaaaaatgcacttaaggtagtgtttccttcatactcccatatttgaaaagctgaaagtaagttgatggatgtcttacaattgatgacatccaagaattgaggaaatattatcctttgggtttctgacacaatactcatattttgaagtgacatctactgtgacactggtaacaattgctaaattcatgaaagacatgtagaggcagacaccttggacattaaagctgagaacttaaatctagaagtaatatcaagtttcactgaaactgtgatcacaatagataaggaaaaatatttgggaggtatcaagagggtcaggtagtgtatgatgagaaaataaaaagcaaacagatttttcattaaaatgcacttaaaaagctcaatgtaccactgtaaagtctctagttacaattacttaaattgctaacaaaagtaaaattcaaataaaaaattgttcattgtagcatatcatattttaatattaaaaatttaaaaatgtatcctaggatgaagacattttccactaatttcagtttttaccctagacaattcacactcaatgatacagcaaattagtagttcccatagcacactgaataaaacaagagcaaaatacatcaggtggtttgattgatgaataaactatggaatattctagggcctgaatctctttttcaaccagataaagattagaagagggcctcggaaatttgtctttctttcaagtttctaaaaggtttattccgagtccacaaacctcctctgggaactgattctacaccacatgttggagtgactctgggagaaaagggaaaaggagggtggctgggatagagtatggttagggtaaggtgtaaactaaagttgtcctaaaaggcaaagggtaaagctgccttcttaaccataaaatcacctgatggattagattaaaaagagatggatacatacacacatacacacatgcatatccacacataccatattactctcaaaaaaaagaaaatcacctccagtttagcaccatttgactaattgtagctagtcgcttgaaggtattaagttgtctaggcagaggaagaggctatttagtgtctgagaggcataatttttcactttgactctaatgctgatcaaggagaaggagcctgccataaactccagcattttagctcctatgggtaaacagttcttacagaggggggagctacttaagccatatttggtgagggactcctctcactgtcatctagcttcttttgccctgattaaattcccttcagcaaatttggagataaattgatctgctactgagaattagcaatgtttatttatgaaacagggtcttgctttgtcactcaggctggagtgcagtggcatgatcatggctcactgaagcctcaacttcctggactcaagtgatcctcccacctcagccccctaagtagctgcgactccagacacatgctatcatacccggttaatttctgtattttttgtagagacagggttttaccatgttgcctgggctggtctcaaactcctgagctcaagttatccacccaccttggtctcccaaattgctaggatgacaggtgtgagccactgactgtacccagttagcaatgtttatttttaaaaatttgcattgaggattacatctcaaactcctaagagtctggataataataatagcaataatacatcaagatgtttttggttataaacaacaggagacctagttcaaaataaagggatacatttacttcaaaaataaaattaccttgtataacaagaagttccaaactaatatggctccaggttgttgggctcacagatagcatcacagacccaattctttctttccagtctgctattcttggtagggttactaatacccctcatggctaccagatggctgcacatggtcatgccattatattctcacataccaatgcctagaggtgtacatgacacatgtacttgtgcatgtgagtgcatgcacacacacacacacacacacacgcacagacaatactacctctttgtgtctcttttttaaacctaaaaaataggctaggtatgatgactcattcctgtaattccagcactttgggaggccgaggcaggtgggtcacttgaggcaaacctgtctctactaaaaaaaatattagccaggtgtggtggcatgcacctgtaatcccagctactccagaggctgaggcacaagaattacctgagcccgggaggtggtgattgcagtgagccaagactgcaccactgcactccagcctgggcaacagagtgagcctctgtctcaagaaaaataaaaaatctaaaaaatctttctctatacacatattttccaacctcatgagtcaagagatagattacacggatgccataaaagcatccttcaaggtgaatggagcttggaataaagaatccatattcaactctggaccctaggaatgagccagccacacaactggttgaggtgctttccctagtgaggagtctaaatggtgagttataagccttggccatgtaggcccagtgtgatttttaaaaaattacttttatcataggatatagtgccactagaaggaaccccaagacatctcttgagttccacctatatccttttcttttgccacactgtgtagtagtatttccctctggttatcaggcttaaccacttcaatcacagcataaccacctcccctcctatcccgtcttcctcccttttaaaattttgatatgtttgcttagtagcaggaagacctaaactggcaagaaggtagggtcagctaccaaccaaattgttgtgccacaggtgccaatgttcctcctttggatactaaggcctctaacccagcagagaccagaaacaaggaaggctgaatcacatgttttaagtgtatcactagttaaaatggcgttacagatgcttggatgccttaacaaaggccatttccctgtttttcatttcttctagcatcctagctgcagttgttgaattataagtctaagccaatcatgtaatctttctattctattcgctagtgctctaggggtgctcgtgtgattcaattatgttctataagaaatgagtagaagtacgccaaaggcttctcaaaaagatttttctccctaataagtataaggaatatgaggagaaagcttctttttctgcctctctttctttgtactggggacactattatgggggaagtgatattttgagttgtggtagcatcttgctatcaagagagggtgaaagtcaacacactcaggtccatcaagagatcatcatctcactaaagtaactgggatacctgcatccaggactcttttgaagtaaacaaatgtaaagggtttaagtcacagtttaggttctctgttccttgcagccaaaaacatcttagctgatacatacagggagaagtgggtactgcaagaagccagtcataaaatgtggaacatgctgagtcgagcagcataatgaagggtgctgagaactcaattcttcctagctagatcttagtttatatcacagccaagaattagaatttcgagtttatctttctctttctttatgctatctggcattgtttgaagtatgtgtgtcttactgtcaacttggttcacattctactacctgtaagtttattcctgagagattcactttcagtagaaagataaagccaaatttctagatgtatagaactaaggataaaacctcaaaaggtagtatattttctaaagtaaaaagtatcttagtggcctgtcagctttcattaggaatacttctgtgttgcaggaggtactaagatttaaaagagttagtacagagaatgcgataccaagtaaataatgatgaatggtctattagttacaaattatttgacacagatatatttatcaatatgtacaggcagttatttgaattcaatattgctttcaggtttattgccttacccttactgtccaaagtaatacttccctttccaaatcagatggtaatcaaaatataaaatggaaaaatctctcagtctgtcaagactcaattcaactctcagggtttgtttgtttgtttgttttgtagtaagtactatcagaccaaaggaaagaaaacaattacagacccacagactttgataagagagaagattacatcagataactgcaagtgaacaacagggtatttcaaccattctaaaatatttatttatacacagtaggattacagataatctatactaggttatttcaaaatgtattccctggaatgtttttaccttcctcctcccaaaaaagaacaccacgtcaaacaaaattagatatatattgcatataacatcccccttgttagatagtcacgatgtacatcaaagtattaacggctttgaaaagttaggctgtaaataagccaactaatcataatctatcatgttcaaattagacttaagaattcctttttaactgtgtattcccaaggaatgcacttgggaaatgtttattggtacattctaataatgcccatgagggttttcattccctaggaatagaagttaaagttatttttcaccactgttgctacgctatgaagtaatggtaatgacgattttgttgttgaatactggagcaaaaagtcattaacatatatctgagatactatttttaagaactgaatgtaaattcctgaaatgctttctataatggagaactacaaatttcctgtttatactttagctggtccaataacaaaaataacatgttatcttgaaaataagttgcatattcatttctacctcaaacatgtggataggtcaaatttaaaatatttttataatagattatttagtaaaatgtataaaattatacacatgtggatatttctgcataaataccagaaaaatgtgcttacatagtcattaaaaaaaaaaacttgttatctgaccccaatgaggatatttaaaacaaaaactgtttaaaaacacaattacacaaacaaaaataagcctatattaaagttaaaccatgttcactaccaatttttcagatcctaaatttaaaaataactacgtcaagaaagtgttttaatatacattggagcacaagtaatatagtttactggttgttaaataaaattacttcattatactactgctagtggaataaaattgacacacacaacttgtacatgcagggaaaatacaacttaatgtaaacagatggttttcagcacattcctttactagaatgtggccacctgccacaaagtacacaagctcatgcacaagatcaagacgttacatacagctgagatcacaatgtcatgcatagtacaacagcgtgccagattatcgtaccacaaactgtgcagatgttctcccccaccccatgagccactgccagcagctgctgtggagcttggttacccatatccgtgacatgaacggtgtcctttggagaatcttgttccctgtggctgtaagtattcttatttttataatattttaatgatgtttgctatcaaaatgttaagtacaatactggaaattatgaaaaagtagactttttacaatactaagcaattatatacatcttatctcaggtacttgcaaaaagcatcacatatttaaacgtatcatcaaaactaatttactgctcagagttaaatgaacctaaaataatatatctgatgacagtgctccagtgagtggggaaaaagaaaacaaaatacagtctccaaaaagtactgcctaattttgagcactcaaaaaacttggcaagagtcattctaaagtctggctaaagtatgactcatacagataagtgctatataagaacatttattaggatggatctttcacttacatgatttcaattttgaatacttgacttggtaaacaattagccaagttaacattatttatgttagtcaatgaaagaaagtacagaatatagtcactgaactacttcccctcatttctctgaccttattaagtgtattgcaatgtcctttttttcctatatatttcctaagtgcattctggtaaagatagcattttcttttgctattaggtaacatctgctaaattacatgttcataaaagcatagaatcagaattttggaacctcaagacacattgagtggctcagctctatgcctcctgggagtactacatggcccttttagaatgataaattcagtgcctctggaatgttccagagtatctttaaatcaggccagggagtaaaaaaaaaagaaaatacagccaactctcaataacaatggaaggtaggatagataagtaaaatctgaagatctaaaaatcttattttaattaataacttaaatcccctcccttaacaaacatttgacttataattttaaaaaattatgtcagatataaaaacaacttgaatttgagctcttttctctgccccctctccaaacaccctagaggaggtactaacaagaactgtatagtttgatattggtagctgcaaggatgaaaacctatttatatgtctagcttttccaaattagatatttaaacctatacatataacattttagcatatgaggacccatgtgtattttcatctttgtgtaaaaatgattgctttataatttgtttaaaaattggcattcctttagcaaggaaagactacttaccataatcaatatcagcaattacatccaacttttctgactctgtaacaatctacaacttagtacttaccaggttacatttctcttataatgtaacatttgaaagtgatatgaattgaagatgacagttttactcaacatcagaataattcatgacaggagccagcatgccttgattaaatgggcataataagactggggcttaaaacagctgcctctcctgattcttatgtactgtacagtacagcactgtaccattctgcctcagttttactccagcaatcatcattcaattacctcaacagactgatgcaaaatatatatctttattgtgactattattaagatcattgagacagggtctcactctcacagcttattgcactcttgacctctggggctacatatctttattatgattatgattattatcattgagacagagtctcactctcacaacttactgcgcccttgacctctggggctcaagtggtcctcctacctcagcctccggagtagctgggaccacaagaatgcaccacaatgcctagctaattttttaaaaattttttgtggagacaggacctccctatgttgtccaggctggtctcaaactcttgggctcaagtggtccgcctgcctcagactcctggagtgctgggattacagacatgagccactatgcctggcctgaaaaatatatattttattataaagttcatcatatgaactgttttaattagcaacaaataatgtttaagtctaaataaagaattaagaataataaagtctctataactgtgccatcatttgaatatgtaagtgcagcagaatctcttgtaagagcaggtatgccacagtgcaggataaaaaaagtgacgttcttatgttgccatatgtttacatggacagtaactgggatttgaccaaaaacaaggtgaaaacaagtatattttataataaaaggcatgagaaaaaatgtgcaataaaggcacaataacaacatttaaatttatgataaatagtttatccatttatttgcctttctgaagaatgatcatttgattctaaaaagcaatattatattggtaaatgtgtaatttgaacttcgtataaatcattctaatttcattaaggtatcagtttgctattcattgacagtaatacctctttaaatagtgatgaaagaaaagaaatatctgaatttaaatattatacctggctttacaatatatatactttgttatatttctggagatatgacttaactggtaagaagtgtatcagtaaacctttgcaatggcattttattttattttaaatttatgtaccataaaaatttaacaaaaaataaaccatacataagtaaaaatcaattgattagaaaaagatattattggtatttttatatgcatacgtataaaattggtatttttgtttaagactcaaatattttacataggagaaacatttccctaattataacaaagttaagataactttagaaaatacttggctgtatgatttgaactgtcattaatacctcgacaacaaatgaaaaaaagttgtttttgaaaattaggtaaattaaaataatgctgcagattaaatttttccacaaaaaataatgcacccaaaagtagtagttctgagtgctgtataattttcacttagatttctaagaataaatctgtaagtatttaaacatttctgaaaatctgaacttttccatgacatagtaaaataagaatagagaaaaaaaaaatcagtgaaaaagttgttttcacattttgatcatgcttacatgttatgttaagaaagaattaaataattaatacaaaattattcaattttataacaatctataaatagttcctatgtcaacatggaattatattgttaaaggcattatttgaagacaacgttttgatttgtcagaaaatagaacaatgtcctcaatgattatctttgataaaagtaacatcactactaaggaaaaacaataaacagaaaaaaactgctgcagataaaatctgatgaacacactctgtgttcttattatcaaatttttgtgctctctacttataatgtactaatattgtaatcaggtcagtagaggactgaatatatatcatggatgctgctacataaagtgaacaggtagaaaggttagaacgtgacatggtaaggcgaagaaaaatgactatgtcacatagcaatagtttaaaatattggttttctcagtgatcaaaaaagcatgttcaatgactttttgttttccctgctagtttatgatattggaaagctgcagcaagatagtaataaaggtcactggatacaaatattcaagttcttcactaacctcatctgggttggcattaaaggtgaggctgccttcatccagctgcatatacaattttctaaaagaaaatcctaaaggtgggttcttattgtatatggaacagtgaccccaagtggatttgcacaacctataaaatcagagaaaatgagacaagaaaacattactacatttaatttcctaagttaaatatgcatatacatgcaaaaatagtaacatgaaataagattgaattttatagttctaaagtttaaaatttttaagtttgtacttgttttctatttgtttactagagtatgacagatgctttaaatttagcaattttgacagcatctaataaatgtgagttatagagattaataatattcatgagtactatctgaagttaaacataaactattcctaataatagtaataatagctaacatttactgaatacttactagatgtcagaccctatttcaagtattttaattggattagcctgcctaatcttcacaacaatcctatgacgttggtgatacagataagaaacacagacaaaacagttgcccaagatcatacggctaatatgtacagatgcaggatttcaacccaatgagtaatccacagcttgcaattattaaccaagaatctaaatagggtttattaactaacctatgtgctctattgtgaaataaaactaaatgggaggaaaagaatgctgggcagggaaacagcttttgtttttcaaataatacacgttacaacagacaaattaaatacagaaattgtttgtaatgccacaacttgaatacattcatcaagctgtgatgttcaacatagctgtttttaagatactgcttcaaaaacactagttctttattatcagagtgatacatgattgtttagaaattctataaaaccgaaaatactaacagttcatatctcaaaacacactgcagattgggatactttctaactcttcacagaggcaatagctactggttatttgaaagttaatgttttatcttattataatgcctggaaattctggatatccaccaaaaagccttaaatataaatgcattattctagagaaacagagaatactgaaattatattctgatacaattgtgatgagtctttgtctcaaaattatctgatttgttgtgtattcaaaaacacctgctacttgttgagacaaatgaaactgtttactttcttatattcattattaatttctgcctcagatttccttcttttaataaacacacaaagtgcagagcaacaagaaaaagttactgtctgagcatataacatcaaaaattgtgaggacaagggggtaaaatatctaatttaacatgagactaccctcttagtagttgatttatactgctgcattatttttacccaccaaatgaaatcactgactcaaaactgtaagtataaaaaattgtttagaatattatcaatattttttcagtcttattaatctagtcccaataaaacccaaaactagagttttattactaagctttgtgaaaaccagagaacttcccaacatcaatgagtattcaatacatccaaagttgaaattaaaactaagccagcctttaatttcaaatagaagcaatttattattaaggaaaaaatccaagtattataaaaataggcataattatggcaaatatttctttcacaaatgaaaaattcagatttaaaccccaaatgaagaatacattctggttgacttcaggtaaggctagaaattaaacttttaaaaaaagttcaaacaaacagaaattaagttagtaaggaatactaaaatgtagaaaagagattagaaagaatgagccagtttaaaagtactttcatttcctcttctattcatgagtaaaaaattaataacatttattttaaagactcctcattaacagaatttcctctcacgtagtactttcactatgtcaaacaaatgagtaaaagaataacaagatatgatattgatgatttttatctatttagaggttgagaaatgacctatataacttgtactagaactgtgtgacatcagaaagcctaatttaggaatgtcattactgaaaatatattttgactaaagtttgtaatttattaagtctctcaattagatttctagtttgaaattataggaagtcttaaaaagatatttgtttttagttatagtctatatttttataaagacctatttcaagataataagacaaataaactttggtaaaggatgctagaaggtctgagatccaatgattccatgtttggtaatatttttaggccaaaaaatcatgtacctatactttttgttaaagtatatgatgctatttaaggagtaacttaggttcaataaaacagattctattccagcaaatgttcttagatttgtggttttaattcagactagtacaatgtggaaatttatgtaatctaagttcagcaagtaaataaaaacaactatttgtccccttgctttctaatatttgcctacttcattgaaatgctggttagaaaaaaaaagtagataaaattttcaccagttaaattttattctaacaagcacctttgaagaaatatagaattgagtaaaaatgtaaggctctatatgaagaaaattaaaaacagtaacatttgaggactattcattgatttcgaagtctgcctattattcagatggcaggtatcctatgggaagcacaaactacacagcatgtgaacactccaacttttaaattagaaattctcactccacaactttgcggtattttcagaataaagtgagagtttctgacttataatcaactgacagagcctgattggtaacctctcttctaactgtaaagttattattctattttctattgtcctccttttcacaagatcaaatttgactgtgatgctaactgtatatttttccaggttttaataaagagcatctcaaagtacaagcccaagtttaaagaaaatattttgtaatatacattataaaaagaacattgaagcatgattatgtttagagatacctgaattcaactttggtgggtttaacttacccttgccagagaagttcatcattcgcaaggtcctgccaaacacatgaagccaagcaaaggtcagttgcattcaggtaggacaagatggtaaagcttagctcaggaggcaacatttccaaattaatgaatccttcctgttctttcgatttccttgccttcaaaagatgatatatgtcaatgcctccttggacttgtttacgatgattggtgttagaaatgttgctcgcagccattctcctgctctgctctctggtgaggtagccttgctcactgtagccttcttgttgcagctgctggtttctgaccactctccacaacccttgacccatctgcaagcctgggaaaaagccagaatgtaataagggtgacatttaaaaagtaacccatttttcccagtggtataacaaatctgacatgaagcattcatttatcagaattaaaacttctcattaaaacctactaaaaccagaagtatattactaagaatagctggaaaattataagtgcaaattttgatagacaaagtttcagaattacttggttcgatcatcacctttatcccagtttgctaactacttctaaagtccatatgtgacataatcatttttcacgtggtaagatttaaaagttactgatgtccttaatactcttacaaattataattatgtggacttatgggccagtattaaatacagctctgatcagagcacggactttagttaaaaggcctccagaccctgctttttatcacaattcagtctaagctaagctagctccttttaaccaaactcccagatgcgtaacagctgggaaacaggcttttagtttaattcttgccagtctacacttacattgtagactgtaataaaatgtaacataggccctgaagtctaattcagaaaccttgtaaattagacacctagaactccatgataaatagctcggtaacagtagactatttagttttgttgttgccttaaattaaaaattgtaatttagagaaattttctaattcttctccacaaatccctatggattcttcagaagtacctgggaaaagacaccagaagaaaggtgtgctctagtctccccactaccatctgacctcccaccagagcattctacatttgtctgtcacatatattgacttcctcatgtacaaatgtattagaaaattcctagagctagatttggcattgcctttaaatagcttttctggagcaaataaagtcattcagaacaactaaatcggagttcctaatgaatacaaataattactttcatgatctctttttcaaacaaaatacttttatcaactcgagttgactactaatacctgtgtgtttcaaaaacttggaaaaaatactaactttcccataaaatcattaaaatagtcaaataatttttatagcatgacccgaacttaaaatataatgtggcttcaattaactgtttacaataagtactaacaaaaacaaaagcaaaaaccccaaaagacaaaaaacaaaccaacaacagtgactagatatcttttaatcagaaataatttgaaaattgagtggaacttcaaagaatgtcaaagattgttgttgattaaaacagaaaaaatagtgggcagactagagcatgccttcttctggtgtcttttcccaggtacttctgaagaatccatagggattttattttagtatttaaaaaggtataatccacgcatttatttactaaaccattggctattatttgggtaatggccactaaattcggtcatttgttgattaaaacagaaaaaatagtccaggataatttttaactcttcccccaccttatattgcactgcttggaatcccagcagcttaagctatacaggtatggtggggaggtacaaagagaagaaacatattaataattttaaaatgtaggcacatttgtttttgaaaagaaggcacaaaagataacccttctctccctactacacacgacaccatggtattttttcctaaatcagtggttaagctatacaaataaaattcttaaaaaaaaaaaaacagaatatcgggaaaataaaaagacaagccacggaccaggagaaaatctttgcaaaacacatatatgataaaaagactgtgcatccaaaatatgtgaagaactcttaaacctcagcagtaagaaaataatccactttaaaaatgagcaaaagatctgaatagacgcctcaccaaagaaaatacacaaatggcaaataagcacatgaaaagatgctcaacatcatatgtcgtgagggaactgaaaataacataactatgagatactactacacacccattaaaagagtatatccgaaacagtgacaataccaaatgctggcaagaatgtaggaatgcaaaatgatacaaccactttggaagacaggtagtttctttaaaaattaaacatactttgtatgattcagcattagctgaatcatttacctaaataaaagctttttatttaggtatttacctaattaaaagctttttatttaggtatttacctaattaaaagctttttatttaggtatttacctaattaaaagctttttatttaggtatttacctaattaaaagcttatgtccacacaaaaacctacacgtgaatgtttaaagcagttttggtaattaattttcaaatcctgtaagcaactacgatgtacttcattatgcgaatgtataaataagctgtggtacagtatatctatacaatgggaaattatttagcactaaaaagaaatgagctatcaagcaatgaaaagacatggaggaactttaagtgcctattattaatgttaagtaaaagaagcaaatctaaaaaagttctttactgtatgattctaattataagacattctggaaaaggcaaaactatggagacagtagaaatgatcaacgtacaaaaaatagagaatgtcaacaaaaaattataagtacaagttttatatttgtttaaatgtaccatgtcacattacaacattaagtacaacttaattttgacacaaattgaacattttaagtctactaatcataaagaaaagtattttattttcaccattgctattcctctatttaacttagcaagaaaatatctagaaatcacattaattgctgagctcacctagcacagctgttattttaaataattaaatttattctcttttgtttttgtaccactaaaggtaaattatcaaacatggtaactgcagtatctgaagtctcaatatttaaaacatttataacaatttcagtctattttcctacagaatctttctagtggcatatggttaagcagctgttgctactcttaggcctgttgctagggaacaaagaatcagggtgatttccctaggctccggactttaatggggatcacttaaattgaacacactggataatatgattcagaaagcatccggcaggtagaaagaggtaaagccagcagctggttctttaaaaaataataataataataatggggaggttggagggttgaggctcatgtatacatagttcagacaaagaaaactgcaaaattataccttattttctgtattcctactgctaaacaatactgaaaattgtccccttgggactttcgtttccctttaaagcagttcttgatcctgggtaaaaacacagtaatgataaagcactctgagaaagagtaacatcatgagtttagcatttggagaaagaaaagggagtctgtagcgttctgcccccattccctatcttccttagcataatagggatgtgaaacatgggtgtaactgtcagaaaagctttaaaactctcaaaatgacgtgacatccattgtataagttgtaaagcaagtcatggagggagtatagtggtatgggttttgaagtcagacagacctgggtttaaatcctgactttattagttcttacttacaggaccctgggaaagttacttgactactctgagctttagtttcttcatgtacaatgcaaaaaataataatgataaaaatgtctatagctcaaaaagctattgtgttaagtaagataatgtacataaagttaatttcatggctaacagttaactaacagtcaatacgttagatattactttgacaagcatatttttatcaagtgaaaataagcactttcataaagcttatttaatgatacttaaactgttctgatgtcctgcctgttgaataagcttatttgttcatgttgctacttgcacagctttgtagggcctctacacacaattcacctcctttagttatttcatattgtgaccatgtttttatgttgtttcttcttgtaaatccaattcttttatatcaatgacccagcaacaacaacaaaaaactctagaaaacaaaaaaaggctgtgttgtctttcacagaaaattttaaaactcagcatgcctgaggatggtgccaatagcagttccatgaaataggtctttgtgttattgttaataatctgtcaagatgtggctaggtatggtgactcatgtctgtaatcccagcacttttcgagaagctgaggcaggaggactgcttgagaccaagagttcaagaccagactgggcaacatagaccccgtttcaacaaaatacaaaaaaagttagctaggtgcgatggtgcatacctgtagtcctatccactcaggagtctgaggcaggaagatcacttgagctcaggagtttgaggttatagtgagctatgatcacaccactgcactccagcctgagtgacagagtgagaccttgcctctaaaaaaaattaaaattaaaaattaaaagaaaataaactgtcaacactagctctaaaagagatgtagaatatgatgcagtttcatgcggggttcgtccatgatttcaaactcttgaaaatagtgtttagactgaaccaattaaaacttaatttcaaagtataaagttttcagatttgtgttaaaagttttaataatatcttggtataaagattttaaaactgaaacataatattataaaagatatattactgtcctgtcacttgcagcaattgttaggtaaaataaaattcagctgcaatgtggaatcactgaatatgcaaaaagtttcaaattcaaaaaaaattcaacacaaaataagtttttgtatttgaaatcactagttttggtgtaaatatggattttgtgatgaaactacagctttatttgttcactcaaaataggtggagaaaatagatatttatttctttgaaaaaatatttactcttctaagagcatagtctatgttagtctatctcatacagaaataaaagaaacacggttgcttcttgttattcatggcaattatgttctttaaagtttctgcaaacactgaattagcaatactgaaccattgttcctagggaattacagggttaggttactgtaagcctctattcacaatattttcattaactgatcaatacataaccttactgtatgtgtgtttctgctgaaagacatttaatacatattgctaattcattaactgtgaactcatggccaaccgcactataactcaggcttgaatgaggcttatctaacatgtattttatccataaggcacaacacttaggaaaactagataacgcttctgcactaggcttgggggccattttttgttttgttttgttttgttttgtttttgagatggagtctcgctgtgtcgcccaagctggagtgcagtggcgcgatctcggctcactgcaagttccgcctccctcccagtttctcgccattctcctgactcagcctccagagtgctgggactacaggcgcctgctaccacgcccggctaattttttgtattttttagtagagacggggtttcaccgtgttagccaggatggtctccatctcctgacctcgtgatccgcccgccttggcctcccaaagtgctgggattacaggcgtgagccaccgcgcccggccgggggccgttttaaacactaaaatcaccaagaaaaagcatgtgggaaatgtggcattaaataagccacaaaaaggacacttgtttataatgacagctaagataagaaggcagagccttgccttcaacttcagctgcgaatgtgcaccttgaacaacagttttttcagctcttgcgcatgtttgctaaaggcggcagaagcaccaggcgtactcctttgggagatacaaataaatgttagtgagtaggtaaattcacaaatacaaaattataaataatgaagatcaactgtaattaatacaattcaaggtgtcccatgccttttcttccaaatttgaatttattttgttcaaagcttctttatcatgttgagaggatctatagaattctttctaaggagcttcgaaatgaaaccaaacatgttttttcttggtctacaaacacagaaacataacttcattatttatcatctgacagaagtaaacaaaaatttcataattacttaggtcacagagagaaattatgctacaaaaaaattctccataagatttcaaagttgaaactcttcctttccaaggaaataaaaacaaaaaaaaaaatgggggaaaaaaccccaaagcaatcgcaactgtacattttctccttatttttcagaatggtaataaaatgcggccaggagtggtggctcatgcctgtaatctcagcactttgggaggccgaggcgggcagatcacttgaggtcaggagttccagactggcctgtccaacatggcgaacctcgtctccactaaaaatacacaaattagcctggcattgtggtgcacgcccgtaatcccagctactgggaaggctgaggcaggagaatcacttgaacccgggaggcagaggttgcaccgagccgagaatgtggcactccagcctgggcaacagagtgagactcgtctcaaaaaaaaaaaaaaagaatggtaataaaatgaatacttacaactgaagatttagatactatttagtaaacttaaattgataatttccagagaatgattagcacaaaatagaataaatcagaactcctttataaattggatgaagcatcaaatgaagcaacagccaaataggcaaacgaatatgatcccagaatttctactccctgaaattatgcaaatataactatcaattaattataaccattttaatacagcagtcaactaatgctccttgtgtctcagagctattatatactgttttggtttaaggataaaatattcatgttcaattctgtactacctgcaaatacactcagggagcatggtagtaaacaggaaacttagaagcctgacatgaatggctactgaatggctactgaatgtggactggcaaccaaactgtgcgaccttgaacactcagtggtattgtgtataaacatgccacattagccgagacagagctattttattaaattaatctcatgtataagaatttcatattttggtttattatcatagcttacatttcaaacttaactttctgttcctaaagtcctatgctgctgtggcacagtagctgggaagacgtaaatggaaagtaacatgattttaggaagagtccagcattattaaaaaataatgcctttgagaggtatttatctagaagactgcataaagtttcctacttagctaaaggtccttttatagagcaaacagccactatcacccctatatgatctgttgtcctcccacctgctaacatttcagtaaagttatatctaggattactaaacatatatggtgtttttctttctacaaaagctcttttggtattacatagcttaaatttaatatgctaaacttcaagatcatttttattcatgctcatgtcttaggaatagtatttttttttttttttgagatttagtcttgtcttgttccccagctgcagtgcaatggcgcgatctcggctcactgcaacctccacctcccaggttcaagtgattctcctgtctcagcctcccgagtgctgggattacaggcacctgccaccacgcctggctaatttttgtatttttagtagagacggagtttcaccatgttggccaggatggtctacgaactcctcacctcaggtgatccgcccgcctcggcttctcaggaataggttttaaactaatattgggataagtataaatggcagggtatcatctcatgaccatgatttgcaatttgtaagatatcaattggacaggaaacagaagaaacaatttttggactcacttttgaaacaatcttttatggaacttttttggaaaaaaatctcaaccttggttgtattcttgtaagatggagcacatatatttatcacctctctctcccataaaatgacagagaaaaaaaaggtagaaactacaactaaaagaaaatgaaaacaggacattcatgaacatgagatttcaacatatttctgcaacatgaaaagtagaaggaggagtggctactaatgaagccatgtagagaaagacagaggatagtctgcaatcgtatggagagggaagcagaagcttatgtaccttgcagaaacctcaagaggcttgggagtccaaaacataggacaaggaagagagaaattcagagtcaaatgagcaaaacaatgaggatattaacatctctgggtcactgtttccttccctacacaataagaataaaaatgtcccccttgtatgatttttatgagaattaaatgaaataatgtgcatatgtatatgtaacaatggaccacaacctctcccctcaacacacatacatcacatatctagaatgcttaggtatgtaccccaacccctttccctcactcaggcaaaatgaagaagcatttttgctaaagaaattgaatgacattagagaaaaactccctgccaccaccctccttatatttacaattggcccagcataatggctgtcaaaccaatcacctcaatggaaggaatatggtgcacaaatctgtaagtcacttcttattgcctcaaagatccaatgttcaagcattaaaatgtggctgaaacacttgcatagcaattacttgatttatttttcctgatttcatctggtaactggtcaataaattttaatcttaatttaaatagatataaaatcttatatatattatgtatttgggggatttacctataggaggtactcatcaaagttctgctatacactaatatggtgaaaaggtgcatcttcttctcaacttgtacctttccagtttacttgggacccccttaggggctacaaagaaactcctaaggcaatgtttcctaaacttggattatgagtgttcagtgaactaatagcaaatcaaaacaaaacaaaagcaatgggataacgtcaaaaggacattaggagctaatttgaaggaggcttctattggccaaacctggaacatcaaaataaaaatgacagtaatgaattaattgctccttagtatttgcagtagactggttccaggatcaccccctcatgtcacctcccccagataccaaaatccatgaatgctcaagtcccttgtataaaatggcatagtatacatcctcctgtatactttaaatcatctctagattacttataacatccaataagatgtaaatgctatgtaaatagttgttatactgtattctaaaatttgtattattatttattgttgtactgttactttctatttttttccaaatagtttcaattgtggttggatgacactggatgcagatccacaaatactgaggaccaactgtataatccattacataaaaaaagaatctgtgagtctacactgatgatgatcaataaaaacataaaggagaaggaaagctcttttttagagtagaattctaattaaagaagatagaaagaataatgtagttagaaaaattatcattttaccatcagagaaaaaataatttaggcaagaattatcaatggatgttgttgaatctggagtttgacaaagaatggaatacttacagaatcccaaagtatcttcccacatatcagtcattaattacaagaaaaaattaagaaataagacaaaaccttaaccaaatgatgaaaattaacatttacaaataagaggcaaatgcacatcatatgcctctagatgtgatgccctgaggacacaacatcattatatagtattccagccaaaaatccataatctgaatttaatagggaatatcagagaaactcaaaaggcagtctgtaaaataacagaatattttccttcaaaaacaccaatgccaggctgggaatggtggctcatgcctctaatctcagtgctttgggagagcaaggccaagaggattgcttgaggacagcccgggcaacatagcgagaccctgtctctataaaaaattaaaaattagatgagtgtggtggcatgtgcctgtagtcctagctacttaggcggctgaggcaggaggatcacttgaagccaggaattggaggttccagtgaactaagattacactactgcactccaacctgagtgacggagcaaaactctgttcctaaaaaataaatcaataatgccaatgtcataaaagttaaaaaaaaaaaaaagaaaagaaaagaaaaaaggtggaagaacagttttggattaaaagaggctaaaaacaataccaccgaaatgcagtatgtcaacaggattggaaaaaaattgctatgtcgcacattattgagataaataagaaactagatatatgggctgaagattggataaaaatatggtatcatagtatcaatgttaaatttcctaaacttgataactgtgaaatggctatacagaagtatatcctcattcttagggaacacacactgaagtgtgatggtgtgatgtatgcaacctactccaaaatggttcagcaaaacagtaacgtctatgtctatacagatggaacaataaggtgatgtggcaaaatattaaaaatttgtaaacctggctaaaaagtattcaagggttatttttattcctctaacaatttttttgtaactacaaatctcctagttgtggaatccaggcatgtaaatttgaaaaagatgtgtgtttgagtttatgtactcagtttaagaattattattattattattaccttagggctcagtgtaatacagactgaagaccattactaaagaaatagtggtccagagaggttaagcaaatttgcctgagaagtcaaagctggaaaaatggaagatttaggattcaaactcagttctatctgagtccaaagcttttattcttaacccacaaaccatattcccagaaccgctggagcccatggatgacaaaagcaatttaccatctgtttcttcaccactggttctcatctctttttaccccgtcactgtttattacctccatcgttggtcccagctgcagctgctctttcaggctactgctgttcttgtggaaagcacacaggctttgatgtgaagaaagatcagcatcaaaccccaacacggaatctgattagcctgtgatttctgatcctcattcttctcattagtaaaataacggataataattcttattccatgggacttagtagggataacatttatggaacttaacccatagtaggtagtttacaataaaaggtagtttcgtactcatccctctcgccctctttaaatgataactattattttggttccttcatttcaaatacacctgataactgtggattaattacctgagtagtcataatcctggtcctgaatttcattaatttgggatctgtgaaatttggagagatgccatttacatagcaaggccatagttccaacacgcactagtttcagttaacatggtaaaatgcaaaatgatgactgtaagtactaaaataaggaactgactccacacaataggttacatgaataaacccagtatcaaacacagtgccttggcatataaagtgctcagaaaatatttgttgaatgaataaacgattagtaagcactgattttaaaaaaaatgaattacatgaaccttgacctaaaccttacaccttttacaaaaattaactcaaaatggaccatagacttaaacgtaaaacataaaactataaaaattttagaaaaatacatagaaggaaatctttggggtctaaggctaggccaagaattcccagacttatatcaaaaggatgatcatgaaagtaaaaattgatcgaattcatcaaaataaaaaatttttgctctttgaaagtctatatttggaagatgaaaggaaagcctacagattgagagaaaatatttgtaaaccacatatctgacggacgagtatctagaatatataaacaactctcaaaacaatagtaaacaaaaaccaaacaatccaatataaaaatgggcaaaagatataaacacacgtttcatgaaagaggatatacaaatggcaaataagcacatggtaagatggtcaacatcattagccaggagagaggtgcgtacggttataaaagcacagtgtgagagatccctgtggtgttacaactatttactatcttgactatggtgctggatatgtgaacttgcacagaacttcatacacacacatatgtacactgagtaaaaataaaactaggggaatatgagtaagatgggggattgtatcaatgtcaaaatcctggttttgatagtatattatagttacaaaactattaccaatcagagaaactaggtaaagtgtacaagggatgactctatatttcttgagactgcatgtacatctacaattatcttaaaaaatcatagaaggatggaaaaaaacaaaaaaagtttaaaaaaggataggcaactgcacatttaaagtgaatgaattttattgtatgtaaatgataccttaataaagatgttttataaaaaggaattagaaactctaatgaatgctttaaagagggtgagcaaagacatgggaagtctaccatcatttcacaaatagtaactattttagattttgggaatccaactaattgtgaaaaatctacaacctatgaatcatctctcacttcaggtaaatttgaatacatatggatcaaaagaagatggaattaaggaatacaaatccttatagacacaaatcctaaatgatgttttgaccacttacataggatatataaacaacagagtaaggtacaaatgcaaaaaggatcgatatttgtgtaactcttagtctaataaaaaagacaatgtacatataaaatacattaattagaaaattggtataattacttatttaaaaacaaagtaataagctatatgaattaatttggattgctacaaatattatatttctaatatctgtagaaaaatgcttctacttattaaaatacattaaaattggtaaattttatttagaatctcctatattcttatatgcccttgtttccattaaaataacaatagcaatattaacagtaatacttttattacatattgaccaaatatttatttgacagagccaacttgttttttctgagttggagtcttgctctgttgcccaggctggagtgcagtggaacaatctcggctcactgcaacctctgcctcctgggttcaagcgattctcctgcctcagtctcccgagtagctgggactacaggcgcgcaccgccatgcctggctaatttttgtatttttagtagagacggagtttcactatattggccaggctggtcttgaactcctgactatgtgatccgcctgcctcggcctcccagagtgctaggattacaggcatgagccactgtgactgcctgacagagccaatttttaaaaaaaatttaaatatatttagattttgttttgttttgtttttttgagagggagtctcgctctgtcaacagactggagtgcagtggcgtgtagatctttggtttttaaaaattaatttgtccactttcagttttattatgctaatttcagcataaataaataaaactgaaatctctaaagtgggctatatactataatctctgttttacagtaatgtagaagttttttgacactactactgtggaggatgaatttaaaggtggagctccaattacgctgtaacttgctgtgtgaccttaggtatttcaaacaaggttctgatcttttgtttcctataaaatgggggaaatcattcctatctattttacagggtggctatgagccttaactaagagaatgtatataaaagcatcttttaattggtaaagcagtatgtagtttctgaaacagctatattgttctgacataattttggatgtattttttttaaagtagcagttttagtctaaccaagtctgttacaacagcataaaagcgcttccacttaaaagcagtacaaactatggattaactacaaataattacacatttattaaaatttataagaacaataatagttttctatactttttaacttctagaagatcgttacatttctaagagatggtatttttgactactatgttttgtttcctattcaaaatagtagactatttcttaaaaagactaaaatacaagttttattaatattttgtatctaatacaaagtctatctgtaaaatattaagcagctttaatcaaactatctctctgtaacaagttaaacaccaaaataaagtagtatttattaagaaaaaggtaactactgcttataatttcatggcactaagcactcaaatggcacatgctgtgcagacaataagtaatgaagaatggtttatatactatttgggcatataaaatctacacagggaaagatggcaagaatagaaaggagtccggatgtctcaaaaaagcattctgctttaagtacttttgtttgaagcaaaccaattccataaagcttttactgagcaaacggtgttaaatcattggtatgtaatgactgacatatgaatagcctcatttaaatacacattataaatggtcatttttcttcagtatttcttagttgtctaaatagtggaatttataagtaaatgtcctgtctcagataaaggtttaaaatgtgtgctacaatagttatctctaaaatacaaattctaacgataaggaaatccacttatatgtttttataaattttcagtgcttttaagtaaaaagtagcaactctatttttggttacttcaggttttaaaaatctttaagggatatcatgtgatattattcaatagcataagaacatgggagagtctatgagaaaatattttctgagacattttgaatcaaatcaggagcctagcatttatttcttcacttccaaaagaatagaccaccaaagaagtttagaacagactgcgtagagaaattttttaaaaaagaaaaaaaccctgataaccaatcacatccctaaaatttaaaggcaacaaatgtagagaaataaaggaagggtaagtccacaaggaggtctttctaaggagaaaagggaaatagctaagtactaagaggtcacaaggtacattgaacacataaaaagcccctactcattaaatttaaagatctggtcctgcaagagcagtttttgttactaaaaggcataccatttgcaggttttggttttttttaattcaaaaagatttacaatattactttgttccctgaaggtttttttcctgttaattttattctataaaaagtgttaccaaaatggcaactaaataaatgtaaaaattaagatgtgttatttaaatgcaaccaaaaatctaagaattttaggcttattcaatttctgtggtttgtttttcaagaaatgctccattgtccaactatttgaaactttaaaataaatgtatcatacttctcactagcattatttttaattatatggttcttacttaattgtatcactatttacttaaagtggctgtaatcagctgtagtcatggtagcatatcctaacccaccttctcagtatacacatactcacctgcccactaaccacaaaggccattgctatgagtgctatggaattaaaaaccaaaacaaaagtcataattctcactgagttgcttttatacaaataaaacaaggtattaaattaaatgaatattgaaggcagccagaaataggaggaaggtgaaaaatgagaaaacatttaatagtgaaaagagactgatggaaagaaaacatgagtttgactcagtctccttccttagctagtagggagcatcagccaagtcactaaaattttgaggtctcagtttcctcccctgtaaaataagggttttgaaactggtgttccctaaggtcttttttagctataaaattccatggttccaagagtaattagacaagaaaaaaagtaaaagacaaccaaattggaaagaaagcagtaaaatcctttgtagttaccctaaagattctaccaaaaacttacaactaataaatccattcagcaaagtagaaagacataaagtcaagacacagaaataagtcgtatttctatacatttacaataaacaatctgaaaaggaaattaagaaaataataccaactacaacagcatcaaaaagaataaaatacttaggaattaaccaagtaggtaaaaggcttctggaatgaaagctacaaaacactactgaaagaagtgaaagacaaataaatggaagtacatcctgtggttacagattggaagacttattaagatggcaataccacccaaagtgatctatagattcaatgtagctcctgccaaaattataatgacgttttttgcattaatagaaaaaaattctaaaatccacatggaatctcaagggacctctaatagtcaaaccaaacttgaaaaagaacaacaaagctggaagacactttctgatttcaaaacttattacaaagctacagtaaccaaaacagtatggtattggcataaaaagagacatacagaccaatgaaatagaacagagaatccagaaataaaccatcacatatatggtcaaaagatttttgactaggtgtcaagatcatttaatgggggaaaggacagtcttttcaacaaatggtgctgagaaatcatatccacattcaaaagaatgaggttggaaccttacccaacattatctatgaaaattaactcaaaatggatcaaagacttaaatctaagacataaaactgtaatactcttagacgaaaaaacagggcaacagggcaaaaggcttacagcactgaatttggcaatgatttccaaatgcacaagcaacaaaagaggaaacagaccaactgaacattatgaaaattaaaaaaaaattgtgcatcaaaagacagtatcaacagagtaaaaaggcaacccaccgaatgagagaaaatatttgaaaatcatgtatctgataaaatctaatatctataatttacagataactcctttaactcaacaataacaaaaacatgattcaaaaatgggtaaaggacttgaaaagacatttttccagagaaaatacactaacgtccaataagcacaggaaaatacagtcaacatcactaatcattagggaaatacaaatcaaaagtacaatgagggaccaccttatacccattaagatagttactatcgaaaaaaaaataagtcttggcaaggatgtggagaaactggaacccttatgtattgttaatgtgaatgtaatacgtatggtacagcctctgcggaaacaatatggagcttcctaaaaaaaaattaaaaacagaattaccatgtgatctagcaattccactttcaggtatataccctcaagaattcaaagcagggtctggaaaagatatttgttcacccatgttcatagcagcattattcacaacagctaaaacatggaagcaacccaggtgtccaataacagatgaatggataagcaaaatgtggctgacacatataagggaatgttatgtgaccttaaaaagaagagaaattctggcatatgctacaacaaagatgaaccttgaggacattatgccaagttaaataagccagtcaaaaaaagtcaaatactggataagcccatttatatgaggttttggttctttaccactttccagtaatatgaatacaaacacttccggtttccaaaactggaaacaaaaggtagaatggtgattgctaggacctaggaatggggaaggggaattattgtttaataggtatagagtttcagttttacaagataaaaagagtaatgaagatagatggtgttgatggtggcacaacattatcaatgtaattaataccattgaactgtacacttagaatggttaagatggtaaattttatgttacgtatattttactacaatttaaaaattggaagaaacaattctgtgatcccataaaaataaaatgagggaaaaaactctgaaaaacaaattaataaataaaagaagagatgatggcgtgcgtgtgtgtgtatttaacatctgtcctttccatctcttttttccctatattcatgacttccacaaatcactactccatatagagtctctccaagcttggcttacttgctaaaatctggttccttcattcaaatagcttatgaatcctatgcaatctattcttgaaaaatacacgaactgctgactaaatggttaaactccctaaagctgttgcctaaactccaaaccacaaatatttttatcttatattgctataaagtacttgcaccagcacagtggctcacacctatgattcctgaaccttgggaggctgtggaaggaggatcgcttgagctcaggacttcaagaccagcctgggcagcacagtcagacaaaaaaattaaaagaaataaccacacgtgatggcgtgtgcctgtggtcccaggtactctgaaggctgaggtgggagggagaattgcttgaacctaggaggtcaaggctacagtgagtcttgttcgcaccactgcactccagcctgggcaacagaataaaaatctgtctcaaaaaaatacttgccccaaatatgatataaatttattcaagtcagccaaaaatgttttagtttattagagagctaagtcaagaaatttgtcagaaaaacaaaacaatgagagcaaaacgaaaaagaaatagtgaacataaatttccagaaatagatgtatttcatttaaattgtttaaaaaattatttaagtaaaataattcaagaaaaagaaacagaaattaaatgcataattcttagactttagtattaatgattttgatgcattatcatgggtcagtcaatggaatagtgccagtttccaaatctgaatcaaaatgaggaaaaaattagttgtacattagcagttggttaaataataaaccataaagttacaaatctgaatgactaatttcaacacactgtgattaaagatttggtaattcaatgtttttatattgtaaaatgaggaagatatcttttaacctagcaacagtaaacacacaaaacattccccattaaagtgaccatatgtaataaattatgatcaatgttttggcttatctagaagttactataatattttgtggatggaagtaattgatccaagggccccaagtaatattagttaatttgctgtaacttattattaaatgaagttacgctgcaccctaattcctgatgtacagaaactgataatatttgttgttttaagctggggtaaatttgggggtaatttgttacccagcaatagacaactaatgaagtacctcatcagacatattgtcaggttaattggctaaagatgaatttctgacccaatatgaaaaaaataataaaacttatgcattctttattctgaaacctactctgtttcacatatcattttcgtgaagggtagagttgagaagtgtgtagagctcctacctcagaaatacattacttcaaacattaaaagaaggaagaggaaagctgaaatagaaaacataaattgtcttcactttaccgtaataaaaatcatgatatattcatttgtggatatacacctaggagccttgaaaatgaatattttacttgtaaaacaagtagaatcaattattttattagtaaattcatacagaacctaaaaataaaactaaaaaaattaaatgactgaggattgggatccatttatgtgattttgccaaataaatattgagaaccttctacgtaagagattagaacccagtcgctgagaaacaaataaaagacaagtttgacaagttttataacccaagtttgactactgtagcagctagcaatccatcgtgatcttaactatacttgtgtttgcattcatattactggaaagtggtaaagaaccaaaaactgtctaggaaccaaaataacactcgacccgaaaaccaacacttggacctgaagaaagtaacccttgtcatttctcaggtttatttcacaatgacgctgggttactacttggagtcctaaaccgaactacaccccaatggcctagaaacagaaggaacacacccagttccgcctcctgacagtgattcctcactttaatgagccaccactactgtcactcaagatgcttcgcactgtcattggtcgcaaactcttgctggtcggccagtttcggccaactggcaagcactggttgtctttattttcgagaaaagtgaaggtgaacagggaaaagagacaagagatctaaaatatctaggttgactcctgtacctgagcgacctgcgatctccaccgccgccgcgacgaattggcctctgggcggggacttttagccaaaaggaaaatggctcagccgggaactggtgcccaggccatggagaagctgattcaaactttacttgtccacaccggtagaggtgaccgcgatgagaataccagaaacagcactacgaccctcagaactcagggtacctccagctgcaggggccagaactgccgactatcccaattttgacgtttcctattgttgccggaagtgacgttaggctccgactcttaacggagacgcatttttatttctgttgtttacgattcgctatagattccttgtttctcacttcgtagcacgagccactctgaccatcaagatcagaaaaacttctcagctgcaagttagaagtggactggccattgaggaggctctcagcggagtcgctcttcacaggagtcttgaacgcggtgtggaatcggcagcgaggaatcctggagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtgtatggttgcatatgctccgttttcctctccctgtcgtgctgggcctttgaaaccggcttctttgctggtggctgcttggtgagccccgaggagacggcaaggctgcgcctggtattgggcggaggtcgcctctctccgccgtccttacagagaccccgggcggagacgaatgaccagatccgccttttcattcttttaaatcaaatggcgggaggggagccttgcttatatacccaactagtatatgcttttagtcacaacgaagtgggaagtatcgtggtagctcatcctatcagaattaggttgtgacttagggttggaaagttataggcttactgattcctattggatcctctggggtgaggatacaaacggctcctgactataaggaagacaggacagcagttcgtgttttccttgttggcatttccccagcttttcaaatatttctccacctttattgaaggctacagatttttccctcactgtaacaagttaatcttgaagttgttattctcttttactctggaattatggccatgctagactgtttttttcccgaattatctgcagaccttttaattttatgtgtgaacacagcagtcccgttgaactctttacttgtcccttactcctccccactcccgcccagctttctcgatgctttgcctttctcagacctttctcctatctcttagagaagtatttccctaatatcttttgcagtttcataaactgtttttctcatctttacttttttgtttttgatacgtgtttttagataatatcgagcattatgtgctatgtcacaaactcttagccattgactgttattagagtcagtgtagttgcttcattctaaacaaaaatcactctggtccagtgacattctattgggaggcattgttttaatgacctctaacagcaatgagattgagcgatgttgaaaatcctaaactgctagagtacactattttcacaacctctcccacaagttcaattgcgcagatctgacttgtagacaaggaaggaagctagaaaggaatattgagagcttctttattattgaatctatgctgcaagctgagtggtatctccttttttccttagtttgcctttgatcagtgctataagttgaaaatgttaaatttttaaaagtatttttcattaatgaaagtaaggtgttaaaatgtacataagtaatagattggcttcttttaatgtcttgtttttaaggcttttgaattttatagtagacttagtaaagccctttgtgagaatgtagagcagtagctgtaattttattctgtgataatcccaattttaaatccctttatttttctgtctcctatcacttacctcgttcacgagctctgcttgtattactcttcaaaatatttattcactggtactgaagagagacataactttgttgtcagaaattccattatcagaggtagaaatcatgtaagagacactgaaatgttttccaaaatgtcagaaaaaggaaaggtgagaagatatcataaagtgttacgtaaaacagaattacttgcactgggaaaatggaatatacatctggaaggactaaaggaagtctggaaagacatagaatttacattaaagttactgggaagaaggtatccctagaagaattgtgttacgatagatgggtctggaacccgaaagaagctcagacctactatattggccagtggcaaaatccaagaatacattttttgcggttaaagccagagtagtcctcacttcatgtttttcaggaaagtaaaggcttatcttgggaaatcccttttaggcttccgtgtgtccatctacccccagtcagtctaaaggatattaaatagggtttaccttcttggccagtgttttgtataatgtgatttcaggatgactttctctttttctagttatctcccatttgacagtacctaaaattatctctgtctagaaatgtaaatgtttagttgaagtaatttattggctgaaaaatagtgactaaaatgtgcatgcacaagtctataaagtatattcaataagctgttgcctaccatgttgataaaggagactaggaacagaaaggtaggttcataaagagggagcagttgctctaccctggggaaatggctgtggaaatgagtggcgaggggcttaaagtaggaagcttactaaatttaggattttgtaaatcggtgaccttcttacctttccttatttaaagatagagaaacggtgtgtaaagggatgatttgtatcctggacagctgggtaatgcgaattggaggaaaagatcacactaacccagcttcacctgatttatgaattgttctgttttcattttaatataatgacttcattttaatgtgataacttcattttaaaggagcttcattctcaaagggttcattactcaaggtattgttatgtattacttttcttctatgaagtgtccatggacagttgtggtagatgtttttatgtaagttattgagtttcacgttactggctgactagacttttatagttcagaaacttacctccttccagcaaaggttcttaatcgtttatatacctatttatgactcttctttgggaaaaatctcctttgataatctaatgaaagtcccactccatgcaagaaaattagtcatttagaaataaattccatgctattacttttggggcagtttttaaaaaatgaatcattttgtttaaagtctcagttcgttcaaatcttttggttcacgtatgtgtttttctgttgtgtacattcttcagagtcatattcctgtttcataggccccatgtatgtcagcttttagtaggtatcaccagtaagttttccaaaataattgtaccatttactctttctgtaaaaagcatagatattttgaatttcttgcctttttttctgtgttcaccttttcttcttggaagtagacagctggctaaccagcaggagtttgggaccgatgacagtgcaaaacatcttgactgacaatggtggtggcttattaaagtgaagaatcagcatcaagagggggaatcggtgtattccttctatttctaggccattgggatataggtcgttatgggaccccaggtagtaacccagctcattctgaaatagagctgagaaatgacaaggattaagtgttgcttttcaggtagagtgctattttggacccttggcacagattttggttctttattatgataagtaccaagaaggaaaagaactgggtctattagagaaaattaatgagggggattaattagtttgggatctaagacttatttgaggtggtgacatttaagcaggatgccgaggggtattagccagatggagaatgggagagggaaggagttgctctgtatctcttcaagcttgaagaaatggcatgtgcaaaggtgttgaacagcttgagatatcaccaaacatccttatccaggtccaggaactttatcccagataccatttctgttatttgttgctttctataatattttaaattaactaaatcacacacattctctttttcatcattacttggtaagtggaatgttttgattttcccttctggttatgatttacatgtattaacttattaatacacgaagatcaaaaagtgaccaaaattgttcaaaaggtacaatttattataggataattataattatttcatgctgacaatatgtttataagtgttttgcagtaacctttttgtttctataatttcatggtaagaaagaaaatgaattaggtagagctagtaataccaggtatagacaagaatgtagtatttaaagctaatatctgaaattctcttcttgcatctgctaactgaacgagaaaattctgtgtgtgagaatggaaaactttgggtgaaaagtgaaaacttggattttgtagtccaggcccttaattaagtagataacacactcagaaggagaaaatttggggtgctttatatacaaagggactatttttagaggtgtgtgtacagggatctggtgctgcttcattttttaacctgtttattgcggtatgattgacatacagaaagctatagacatttaatgtatacagtttctgtttggagataagtagatattgtgaaaccatccaaccattattactacaagaaatcaatgccatcaccttgaaaagtttccttctactcatctttttttcacgttttgtgataagagcacttaacattagatctaacttcttagcaaaattttaagaatacaatattgctaatcacagacactgggttgtacctgcagatcttatttattttgcctaactgaaactttgtaccctttgaacaacagcttcccattttgttctccccatgttcccttacaaccaccattctattctctgcttgcatgtatttgactattttagatttcacatacattgagataatacagtatttgtctttttgtgtttagcttatttcacttagcataatgtccttcaggttcatccatgttgttgcaaatggcaggatttccttcttttttaaaggcaaatttgtttattctcacatttttgttggggtccctaaggttttctacatctaagatcatgtcatctgcaaacagatattgtacctcttctctttttatttggatgtttttaatttatttttcttacctagttattctggctaggacttaaaatactacgctgaataggagaggctaaagtaggcaaccttgccttgttcctcatcttatggggaaagctttcagttttttatctttaagtatcttagctgtgggcttctcataaatggactttattttgtttttcctttacctaatttgctataaggttcttccatacctagtttattgggagtttttatcacaaaagagtatcgaattttgtcaagtgctttttctgcatctgtgcagatgcccatgtgagttttatccttcattctattaatgcagtatattacattggttggttgtcatatgttgaaccatccttgcatcacaatgaaaaatcctacttggtcatggtatatgattcttttaatgtgctgttgtgtttggtttgctaacatttcattgaggatttttacgtctatattcatcaaatgtattagactgtagttttcttgtagtgtatttgtctggctttggtatcagggtgatgcaggcctcagaatgactttggaagtgttccctcttcttttttttttttttttagatatgtttaataaggttttgtattaatttttctttaaatgtttgctagaatgtatctggctcttggcttttctttgttgggaattttttgattattccatcaatctccttttttgttatttgtctattcaagcattctatttcttcttgattcagtcttggtaagttatatttttctaggaatttacccatttttttttagattgtccaatttgatggcatataattgttcataatagtcccttatgatactttttatatctgtgggatcaattgtgtcctctttcatttctgattttgtttgagtcttctatttttaaagtctagccaaggatttgttgatttagtttgtcttttcaaaagaggaacttttagttttgtcaatttttaaaattgtttttcaattttctatttcatttatttctaatctaatctttattattttcttccttctgctaattttggatttagtttgttctttttctagttccttgaggtgtaaagttaggttgttttattgagacctttttttttttttctttgagacagagtcttgctctgtcaccaggctggagtgcagtggcgtgatgatcttggcttactgcaacctccgcctcccgggttcaagtgattctcctgcctcagcctcccgagtaggtgggagtcccaagtaggtgggactagagccacgcaccaccatgctcagctaatttttgtattttttgtagagatggggtttcaccatgttagccaggatggtctcaatctcttgacctagtgacccgcctgcctcagcccccaaaagtgctaggattataggcgtgagccactgtgtcctgcctctttcttcttcttaatgaatttattgctataaacacttctcttattctgcttttactgcatcctatatgtttgggtatactgtgtttttattattgtttgtcttgagatattttataatttctgttttgatttattctttgacccagtattatttaatagtatgttatttaattcccctgtatttgtgaatttttccattttctttctattattgatttctagtttcattccctcgtgatcagacaaaatgtttagaatgtttttagtcttcttaaatttgttaagacttgttttgtgacctaggctgtgatcagttatagagaatgtttcatgtccttttgagaagaatgattattttgctatggttgggtctcatgttctgtatatgcatgttaggtctttggtctatagtgttgtatagtttgcaatttacttgttggtattctgtccggatgaccagtacattatagacagtgacgtatcaaagtctccttctgtattgtattgatatctatttcttcctccaattctatcaatatttgctgttggcattctgtctggatgacctgtacattatagagagtgatgtatcaaagtctccttctatattgtatcgatatctatttcttccttcaaatctgtcaatgttcactgtatattttaaggtgctttgatgttgggtgcatatgtatttttagttgttgtatctttctattgaattgacccttttactattatataatgccttctttgtctcttttgacagttgtcgacttaaagtctattttgtctgatatagatagccaccctgctctcttttggttatagtttgcatggaatatctttctcaatcccttcacttttagcctacgtgtgtccttaaatgttagagtctcttgtagatagcgtatagttgagtgttgtttttattatccatttcagccattccatgtctactgagagcccttaattattaaaaatttaaagtaataatttttaataattaagtacttaattgtttccattttattcattgttttctatttgctttctgtttctcctgtttttctcttgtttgttgtctttgtgatttgatgattgtagtagaatgctttgatttttttcttttttttgtttatttactatactttttattttggttactatggggtttgcatcaaatattatgtagtcatagcaggctttttaaagctagtaacaacttcattcatattcagaatctctacacttctcccccctcttcctcaccaatgtatgtaattgatttcagattttacttctttctatattgtttctattaacaaatttctgtggttgttgtagttactcatactatttttgtcttttaatttatatactagtgttcaatgagatttacgtgccacagatttcagtattgcaatattccatgtttgttttcatgtttgcttttagcagtgagatgtatactttcatatgctttcatactgttggtttagtatcttttcagttaacttgaagatctcctgttagcatttcttgttagggcatgtctaaaagtgacaaactccctgagttttttaatctgaggaagttttcatgttttctttattcttttatctttttcttttctttttttttttttttttttttttttccaggtctggctctgttgcccaggctggagtgcagtgacatgatctcagctcattgcaacctcaacctcctgggctcaagtcagcctcccaccacagcctcccaggtagctgggactagaggcatgcaccaccatgactggctaatttttgtattttttgtagagacaagatttcaccatgtttgccagggtggtcttgaactcctgagctcaagcaatctgcctgccctcagcctcctcaagtgctgggattacaggtgtgagccaccatgcctggctatttccttcattcctgaagacagttttttcaggtaattattttcagttggcaggtttctttttttactttcagtatgttgaatatgtcattccctctctcctggcctgcaagtgttctgctgagaaattcaccaatacctttatggaggctctgttatatgaaataagttacttttctgtcactgctgtcaaaattttttctctgtctttgaattttgacaaattcattatagtgtctattggtacagacctctttggcttcaacctatttgggaacttttgggcttcgtgagtctggatgtccattttcctccctagatttggtaagttttcagccataatctaaatgtgctttctgccccctttctctctgtctttttgccttctggaacttttataatgtgtttattaagttacttagtggtgtaccataagtcccgtagtattacttcatttcactttttattctttttaatatttcttcctctaattgtataatttcatatgaccggtgttcaggtttgctgattctttcttttggttgattgagtctgttgttgaagccttctattgaattttttagttcagtcattgtatccttcagctctaggatttctgtttggttcttttttatgcttctcctttattgaactttttgttcatgtattgttttcctgatttttatttcattttctatctgggtttgtttatttgtttgtttgtttttgtagctcattgagcttaagatgattattttgaattctttgtcaagcagatcatggatcttcatcttgttatagtcagtttctgtaaccttattggtttcctttggcatgttgtatttactaataatcccttgagtctttcattggtgtctgtacatttgaaggagcagttcccacttctgtactaaacagagtgatttcagtagatgaagatcttctcttgctgggtcccttggtgagactgacttccaaaccacagtcacttaggtggagccaggttgtgggtctgcttacatgttcaaaatcaggtctgcggttgtgggcctgttactggggcttgggtgggtgtggttccttctgggttcccagacaaacaagtcttcctgtgagaccttggacaggtgagttgaagcccacatgctgatgaggctgctgctgggtctggagccagttctgtagtcacatgcctgctactggggcatgattctgccttctcaaaatggcttctatcagtcttggactccagaaggatgtcacagccttctacttggacccatcagggcacttttatacatagatggttgctaaattggtgtttctgtgaaggacaagggctggggaggtcctgttccactatccttttctagctaaaaccttctttgatttctttcatagttttgtaatttgtcacatacagatcatttacatattttgttagacttataagtgttttttgtgctatgataatggtgtttttagttttatatttcattctaatcatttattgccagtatataggaaaacatttgacttttgtatattaaccttatatactgtgactttgctatactcactttttacttttagggggttttttttgttaattctttagcatttcctaaataaacaatcatgtcttttgcaaatgaagaccactttattcctttcttcctaaggtattttatttcctttgcttgcttcatttcactagctaggacttctggaacactgttgaataggagtggtgagataggacatcctcgtgttattcccagtctttgggggaagtatacagtttctcagccttaagtgtggtgttagctgttggttttttttgtaggctttatggccattctaataagtgtgtagtggtattttggtttaatttgcaaatctctaatgataaatgattttgagcctcttcatattatttacaatccatatatcctcttttttttttttttttattgatcattcttgggtgtttctcacagagggggatttggcagggtcataggacaatagtggagggagggtcagcagataaacaagtgaacaaaggtctctggttttcctatgcagaggaccctgcggccttccgcagtgtttgtgtccctgggtacttgagattagggagtggtgatgactcttaacgagcatgctgccttcaagcatctgtttaacaaagcacatcttgcaccaccattaatccatttaaccctgagtggacacagcacatgtttcagagagcacagggttgggggtagggtcaccgatcaacaggatcccaaggcagaagaatttttcttagtacagaacaaaatgaaaagtctcccgtgtctacctctttctacacagacatggcaaccatccgatttctcaatcctttccccgcctttcccccctttctattccacaaaaccgccattgtcatcatggcccgttctcaatgagctgttgggtacacctcccagacggggtggtggctgggcagaggggctcctcacttcccagtaggggcggccgggcagaggcgcccctcacctcccagacggggcggctggccgggcggggggctgacccccctacctccctcccggaaggggtggctggccgggcggggggctgaccaccccccacctccctgctgggcggggggctgacccccccacctccctcccggacggtgcggctggccgggtggggggctgacccccccacctccctcccggacgggacggctggccgggcggggggctgatccccccacctccctcccggacggggcggctggccgggcagatgggctcctcacttcccggtaggggcggccaggcagaggcgcccctcacctcctggacgggacggctggccgggtggggggctgacccccccacctccctcccggatgggacggctggccaggcggggggctgacccccccacctccctcccggacggggcggctggccgggcggggggctgatccccccacctccctcccggacggggcggctggcctggcgggggctgaccctcacctccctcccggatggggtggctgccgggcagagacgctcctcacttcccagacggggtggctgccgggcggaggggctcctcacttctcatatggggcggttgccaggcggagggtctcctcacttctcagacggagcggctgggcagagacgctcctcacctcccagacggggtcgcggccgggtagaggtgctcctcacatcccagacggggcggcaggggcagaggcgctccccacatcttagacgatgggcggccgggcagagacgctccttacttcctagatgggatggtggccaggaagaggcgctcctcacttcctagatgggatggcggccgggcagagacgctcctcactttccagactgggtagccaggcagaggggctcctcacgtcccagacgatgggcggccaggcagagacgctcctcacttcccagacggggtggcggccgggcagaggctgcaatcttggcactttgggaggccaaggcaggcggctgggaggtggaggttgtagcgagccgagatcacgccactgcactccagcctgggcaccattgagcactgagtgaaccagactccgtctgcaatcccggcacctcgggaggccgaggctccatatatcctctttagtgagatatctgttaacatcttttgcctattttttaattgtattgtttgtttcagaattctaggtatttttccaattaagttgagggactttccctctattcctagtttgctgagagtatttattatggatgggtgttagatttctttcaagtgctttttctacgtccgttgataatacatgatttgccttctttgacctgctaatgtggcttacattgatttttagaatgttgtactaagcccctgcatacctagagtaaatctgctgggtgtggtatttgataccttgctttagtatagaattcaagattataagtaattcctctcaggattttgaagataatgtttctttatcctttagcttctaacattgctattgaaagtttggtgctattttgatattcttcctatgtgatcttttcttgccttgttggatgtttatcaaaacttctcttttactttatgaaatgtcacagtgatatatcttggtgtgagttttgtttcacttcttgtgtttatcactcattgtgttctttcaatctagagaatcatgacattcagccttaagaggtgtttttgtattatgtcacaatttcctccctcattttctctcgttcatgagatgttgaacctttcagtttggtcctctaattttcttataatttctattccacttttgtgtcttttcatccattgtgtaactataattatctcctcaaacttgtcttatttaaatttttatttttgccatcattttcaattctgttgttgatttctatttaaatccattgtggtctaaaagcagacattgtatgatttatactttttaaaaatgtgttaaggtatgccttatgacgccaaagatagtctatcttggtggatgttccatgtgaaattgagaagaatatgtattctattgttgtttgatgaagtagtctataaatatttgttatatccagttgatagatgatattgtttgtccttactgatttttttttttttttttttttgcctgctggatctatttctcatagaggagtgttgaagtctccaactaaaataggggatttgtatatttctcgttgtggttctgtcagtttttgtttcatatatcttgacattgtgttgtcaggtgcatatacattaaagattgttatattttctgggagaattaagtcctttatctttatgtaatgaccctatgtccctaataactttccttattataaagtctgctgtctgagattattataactgttcctgctttcttttgattaatgttagcatggtatatttttccctatccatttacttttaatcttataaacaaaatggatttcttatagacaacatgtagttagatcttatttttgatccactttaacaatctctggctcattttacattctcacaagcttaatattttttatatccttctattcttgttttaggttttaatttttttttctaatctcattgagaattgaaagcttcattttgaaattttttctctatattatctctatttccaccaaatttttcttctctgcttattttgtttaaggtatttatatatacttttcatactgaagcttccctctaatagttattgacctttgggcatatattcagttttaaacatgagtctctaagaaaaaaaggtgcctggttagggcttatcaataagtgagtttgctgcaggtttattgggcaagacctgcccttttcaatggggattttcctcaaatgtcagaaatgtgatacttttttctctaggtccatccaccttctctagcatagaacctgatagtctgctgtcacagaggatgtaagtctaacagcttcttgaggctgagatataggaagaaactttattagtgtgtgtgtgtgtgtgtgtgtgtgtgtgtgtgttttcattaatacttctttctgccttcgaacacttccttctgtattgttcgccttgcctgatgttaccaaatttagtgcctccttgattcaatttctttggagtgtaaagctcttttctctttccagggaaggtgagaggtagttgccttgctgagcaagttatgtgtgtagggataggaggcgggagggaaaataaattctagggttagctgcttcttatgtagactctcaaataatcattcttatttcagccccctggacttacccctttgtctttcagaagcatcaagtgtacctgatttgtgaacctatcttgcttcagttggtttcctcctaaatattaggcagatgggattggctggtctgtgctctgctaggttggttatcccttattcatttgcttttcattttccaaaattttgttgatacttgttttgttatgtgaaatctcctgtagttctttttgtcctggtgggtatatatgatttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcctgatccgcccgcctcggcctcccaaagtgctgggattacaggcgtgagccaccgcgcccagccatgatttttaattatttactttcattttagtgatctttagaaaatggaaaggaaggtaacatgcatttaatctgtcatatttatccaagtgaaccctgcatttttaaaatgtatttttagtttttaggaaaggtatctttttggcaactatgtgagatcagagccctgtgactctgattaaatctgcgctaaatttgtctccattttttattgattgtgttatgtagcttctataagcatccaaaagagtcactgatggatgttattccaagttgatgtgtcttctcaaacggtgctttatgcttaaaaaaaaactatttgggcaagtgttatataagatacattataataagatgaatataaggcaaacttatttttttgggaggaaaacatgtaggagggtaggggagacaccctatattcagaaacttatagtagttacaaagtagaacttgagtagtagagaagaagctcggggaaaaagagctagggtaagataaatatggtaagtgccaataggagatatgaccaaaatagaatcaagaagcttcaaaaatacagagacttaaccagtatttcatggatttctattttcaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtagggtaagctataatatcaaacttaattgtattcttcttgctagtgatttgagatgatatttaacatgggggactacctgagaaaaatcagattttacctggttcctatttaaatctgccttgaaatgattaaaatatttgagaaagcagggaattataggagtttatttctaagtatgaactaatgaagaattccaacttaaaagatttaaaactgtttagaagcacagtatttatctgtataagttataatctctgtacagcttttaaactcatagaggtataatagattttattatttgtataatctaccattctctcatattcagttggatgatatttcttacagttaaatatatccagaataagaagagattgttgccatttcttgtcagtcttttcttatcatttatttgtttattcttttatagaggaaagattttatacatttaagtcgagtgttctttttcatatggaatattctagttagtagatttttttgtgtatggcaacctgaagattgcgcttaagctctcccatttaacagaccccactttgaacctttcactttagctcccattttgcaactatgacaacgtttttagaatatggcaacatacattttcctatattcatgcctatataatatggtactgcagtcattctgtatcccttcataattctgtttcttcatgacacttacccttaaccttttatcattgattaattgatggattggttaaatgttcattggttactagaatgtaagctgaagtcttggactttgttttttgttttcactgtggaatccccccatctagaattatgcatggcacatattaggagttgattagacatttattgaatgaatgagtgtccagggacaagtccaagttagatgttcaagagtagagggaaacttgtaagtagaatccttcagtaatgggctttacatataagaatggatatccatataagaatggatattctaataactcttgaggttacagtagggagaggtaactcaagagaaggctgaaagtgaaaggatagagaggagagtaaggagaaagtttagctcaagttgctgttattataggcattatatgtgagaggcagaagatatgaaacagatgtaatccatgtatgtaaaaatcatcttgattcctcaaaacatgaaaatcctgaccatccagaacttgcaggggtttaaccagtttgagtagccaagtcttctccttgccactttaagtgtcaacattttaaaagacattttaaataggaataattctaaaatataccagtattatcttgttttctaaatacagtgtttaaacatttaattttcttattacccaaaagcatcattaagaacaacaatttttagattattatataacatactaaaatctgcagggtctattgagatttgaaatgctacttgcttcttccacagaggcactcagattgctagtctccctgccacacacatttaagcacacacacaacacccccatcattttgattcttttttctactttttcacatttgttatgttttctggccatttgctgttttttgtgttggcatctgtttttcttactgtttctaatatgctaagtccttaggaactagataatcaagatttttgaaattgtttaacataaaaagtgttaaatgtgtgcctggctatcatctatgtatagtgtgcataaaatggacagattttgctgttcaaaggtattttttttttcatttcctgtttttggactgtgtttcagatagacaaggttgccagaggagttttctgattgggtgaaatattacagtatttcaaagaaacataaaagaaataattcatatttgtccagtaaaacaaaatgcagtgctatcatcatgtatttgttctctgtcttactaaaaatttgggtggagatggggatgtttatgtgaacatcttgaattttttggaaaacatttgctttatataagtacaaaatactgcaattgaacaaatgtaactggcaaattgaacaaatacctcctgtgctttgttgtgggaaaatcagtgaaggtacttcacattgagaaaataagacaggaaacactaccagacagataaagacacagcagatactgagtagcctgggagtctttcttggagagatcagtatagatcagaaagttgaggaaagcttcatgggaagcttgagatttgatgaatgatttgtaaaaaataaataataattggataagcaaagaagagtgggatacctttctagactggtggaattaacataggtaataatatacgatttagaaggagcagtaagtgaaaagtaatagactggtcaaccaagtcacagttcatgctttttcccatcccatcttcctcatctgtaacttagaattcataatatttacctttggaagtttgtggtagagagcaaaggaggtaatagaacaagtgtttgcaaaaccataaagtgtacttcaattttgtaagatggtacattgcttttattagtagtagaaaatggagtagatcacgtaagactaagctttggaaaatcaatggtaaatagttggtactagagacctatagtaagttttttgagcagacgaacagtggtatttcatagtagtctggctagactggtttcaaatggggaatggaatctagaaagtctcatgtatcacctaattattatagctatagtgttaagttttaaattattataaacatttctaatattttcttgattatccaactttgtggaattatgcttattaaatgcttattaaaaatatttttctttttttcctaacagtttgataaagggagacccagcagcatctttgcccatcatcagctattcttttacctcatactcaccttatgtaacagaacttataatggaatccaatgtagagctcatagcaaaaaatgacttgcgctttatagatgctgtctataaggtattttgagtttatcaaacaataactattagttattgaatgatttttaaaaattaatgatttagtcataacttcttaaatatatgcagcatatacaattgacaggatattttcatttgtatttatctcatttaaatgtagtctctattgaaatcaagatgcaattcatgtttgctttttgaatgttacctattctaataaatacagcaactggtaaatatttgttgttggctattgtttgccctttttaatcaaattttagtaaaatttgatatactggcagaaattagagagtaatgtaattatattcaataaaacttacagttttttagaattatatgttaatttagttgtttgtaagaaggaactattactgacattttttttttattaaactgatatattctttgaggtctgagagcatgtcttatattgtatctaccctagtatttatacttgtactatgtgtatactgaatttaatctcttatttgatttttttaaaaccctgcttttatcattaatttttgcttaagtactgtggtttgtattaaagttagtttttaatggtaaaaacccacttatcaaatgtagtctattttttttttttttttgagacagagtcttgctctgtcaccaggctggagtgcagtgtcacgatctaggctcactgcagtctccgcctcctgggttcaagcagttcccctgcctcaacctcctgagtagctgggactacaggcgtgcaccgtgaccacgcctggctaattttttgtattttagtagagagggtttcaccatgttggccaggatggtctcgatctcctgaccttgtgctctgcccaccttggcctcccaaagtgctggcattacaggcatgagccaccgcacccagcctcaaatagtcttttaaaaaaagcagagttgcagtcaatgaaatgggagcttttatatgtagtctctgtttaatctttctctttcttgcttttgatcccagaagacatccatggaagcctaagaggcacttttaagaaattctagagctccacagagtagatttaggaaactactgatctagtgtgttttttttcattttacaaatgaaaaattgagaccaaaaggcctactgacgtatccaaaaatcacatagtggaagagttataaacaaatagaactatagtttctgactctggtatggtattctagtgaactaagaagtttttctaatatctctgaagatatttacactttttgatgattgactatatttttccatctctctggacagacatctgttctccagcatatcctttgctacctgttttccacctgatacctgtcttactggatcatgacttaacaccagccctatgaattactttagtactctttagttaatggcttggttttccttgtcctctcaaaggtggccattattcccctgaccaggtgggcattatcatttggaattttagaaataaattgctcccaattattacaagagtctgtttcctctgcagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaaggtaattttatgaatagatattaatgctgatgtatgctattaatagatggctcagtattttaatgtataaaatcaaaaccctagacagcaaattatttcatagtgtaattactgtattattcaaagatttgagtaaccttataaagcttgttgtttattttaaatactactctcttgttttatacacctgtgactgggaactcctagtgttaaactaatagttcaaacataatacattttcattacttcttagtttttaaaagtcatgtagtctcattagagtctcattatttgtcagctatatttcatatatgaaaatttaaatgttaatggaattttaatatataattatgctttcacacaaaatttgttattttgactaatacctttttttttagattccatcacaacaaagaaagaaaatcagttctggtaagtcagaacctcctttgggcaatgagaaaatatctgcagaggctgttggcgttgatatcagtggcaggtttatgacctcaggaaaggtatgcaaccacaaagaaaatatcatattgtttaagagttatctaattaatccaatatacagttttcacttttctgattggcacctgatgaacattctagttagatattggagttcattgatttttaacagtgcatgccatatatttttgggcagtatgcctgaagttataacaataggatagaaatataaaattaaatacgtgttctctttatatttctaatttctaattctgccggatttcctaaacagaagagtagtgatttaggaagattatcttatgcagttatctacatttgctcttaattgtgttctggtcttcctaaaacatgggaacatatgaagagcctacattagcagtagtgataggttataatgattcatttatgtacattatatttctgtaaccaagtatgaattatccaataattggtagtccctacacgtagaatctggttttcagttaatattttgaatattttctctttcttgaaagataatttttctgccattatctgctttgagcagctgtggcaaattgaatctaatgcacttagagctacagtgtttctatcactaagggagacttaagctaaaatattatttattaatatattttcagctgtcttccagctggagaagactctgattgaatgatagaatatcagatgaattatcaatggtgtaattaagtaaaggatgtgaatactttctgactgaagtataatctagagtattatttctgccctaatccaaaatacatgagttatgtaaacagaatctattttaaaaatttattcttgggtctagcacagtagctcatgcctgtaatcccagcactttgggaggccaaggcaggtggatcacctaaagtcaggagtttgagaccagcctgaccagcatggcgaaaccccatttctactaaaaatacaaaaattagctaggcgtggtagctggtgcctgtaaccccagctacttgagagactgaggcaggagaatcgcttgaaccctggaggcagaggttccagtgagccgagattgtactactgcagtccaggctggctgacagagcgagactccatctcaaaaaaatatgtttattcctttataccttaaaaaagtgaaattttattataagaaaatgttcttatgccacttctttttaatgtacctgttttgctctaggtaatgaagacaatataaagaatgatacaaagccgccatttttgaataagtgcatgtagtttttgtacacttgcatctctaactcatctaactcttgttagttttatttatgattttctaactgttaaatgacttatatcttgtattcttccccaactagaaggaacatatatgaacagggattttcttatactgattttttgtaccttcattttgcttagcacaggattaggaacactgtgagcacttattaattatttattgatataatgtgcttttcaatgttctatttcagtatgagagttgaggggacagtgtaaattgtcctagccaagaaaaatgtaaacttcaaaacattagacttatttttaattttcttaaagcaaagttttctttgttatctattaaaatttataccagatctttatcagaaatttgaataagtattaaaagttctcagatttagaaaagagtctacaagtacatttctttgtttacaagcaaaagttgagtcaatattaaagcaaattgtctcctatcccagtgccttatatagtatgcctatttgcgcttctgagtcacatatgtttttatagtgtgtatgcaaactgtagaataggaagcaggtagaggatttctaggtaaatgcataccgtgacctaatgctttttttgtcaggacttcttcgttgtcattattaggtttgaattgttagctgaaggtctaataaattgcagtttgtttaacagaaaaattgtaatgagccctactcatagagccagtttttgattatttataagtgaattatttggcaatcttttttaaaaataactttttattatggaacatttcaaacatttacaaacatacccatcatccagtttcagcaatttatcaactctttgctaatcttgttttgtctttattttaaatcaaatctcagacataatttaataaatatttcagcgcttgtcctaaaatgtaagaattgttttaaaagtcataaccccaattttatcatcacacataaattattggtaatgttagtaatggtaatattttgatatatatattatatgtgataatttaaactttttttaatttttaaagattggtgttccttttgcaaaattgctgtatgtttaaaataattgtaggaggatcttctcagcccaaaagcttcttaagctgataagcaacttcagcaaagtcttgagatacaaaatcaatgtgcaaaaattgctagcaatcttatctaccaacaacagtcaagctgagaaccaaatcacaaacaaactcccattcaaaattgccacaaaaagaataaaatacctaggaatctagctaacaagggaggcaaaagatctctacaagcaaaactataaaccattgctcaaagaaatcagagatgacacaaacaaatggaaaaacattccatgctcatggataggaagaatcaatattgttaaaatgactgtactgcccaaagcaatttatagattcaatgctactcccattaaactaccattgacagtcttcagagaactaaagaaaactactttaaaatttatatgaaaccaaaaaagacccaaatagccaaggcaatcctaaggagaaagaacaaagctggagggatcatgctacccaacttcaaactatactacagggctacagtaaccaaaacatcatggtactagtaccagaacagacacatagaccaatggaagagaatagagaacccagaaataagaccacacacctgcaactatcagatcttcaacaaacctgatgaaaacaagcaatggggaaaggattccctagtcagtaaatggtgctttgataactgggtagccatatgcagaagattgaaactagaccctttccttacaccatacacaaaaatcaactcaagatggattagagacttaaatgtaaaacccaaaactataaaaaccctggaagacaacctaggcagtaccattcaggacataggtgtcggcaatgatttcatgacgaagacgccaaaggcaattccaacaaaagcaaaagttgataaatgggatctaattgaactaaagagcttctacacagcaaaagaaactatcagcaaagtaaacagacaccctccggagtgggagaaaatttttgcaaacttgtatctgacaaaggcctaatatctagcatccataaagaacttaaacaaatttacaagaaaaaaacaacctaattaaaaagtggacaaaggatatgaacatctacttctgaagagaaggtatacatgcagccaataatcacatgaaaaaaactcaacatcactgatcattagaaaaatgcaaatcataaccacaatgagataccatgtcacgcttctcagaatgactattattaaaaagtctaaaaataacagatgctcgtgagtttgtggaagaaaaggaacatttatacactgttggtgggagtgtaagttagttcaaccaccgtggaagacagtgtggcaattcctcaaagacctaaagaccatttgacccagcagtcccgttacttggtatatacttaagggaatataaattgttctgttgtaaagatgcatgcatatgttcattgcagcactattcacaatagcaaagacatggaatcaagctaaatacaatagcaaagacatggaatcaacctaaatgcccatcaatgatagagcagataaagaagatgtggtacatacacactatggaatactctgtagccgtaaaaaataatgggatcatgtcctttgcagagacatggatggagctggaggcccttatccttagcatattaatgcagaaacagaaaaccaaataccacttgttctcacttgtaagtgggagctaaatgatgagatcacatggacacatagagggaaacaaaacacattggagcctttcagagggtggagggtaggaggaggttcaggaaaaataaccaatgggtactaggcttaatacctgggtgatgaaataatctgcacaacaaacccccatggcacacatttacttgtgtaacaaacctgcacatggacccctgaacttaaaagttaaaaaataaataattgtgggaggaaaacattgaagtgtttcttacatatttttctctatgcagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggtaacaactttggactttttaaatagatgccagtattttttacttaaatatgtgtaattatttcagcctctaaactttggaatatttctagccttttgaattattaatcatgacattttatctatgttacaattactgaagtgtcaataagtcttactaaaataattcaacaaatatttgctgcatatgtgtagggtgctgggctaagtgttggggtgatgcaaagtagaataagatatggtacttggctttaaggaatctacaatttagtgagacatagcgatatgctactttgcatagtggaggttctctaccacctattttctttattggtgaatggaaaagattggcactttattgcctattcattttcctttctgggtccctgctgttattttctgtctctcttaaaaaaccatttctattactcttaattgccacagaccccaatatgtctgatctctactgtttctgctaagacttctttttctgtgtttctatgtcttgtgatttctatatatctcagtatatcaatatacagttggcacttacaaaaactaccagatggccattggacctacttcctgttatatggcaaaccgaacaatctcaatgcactaagtgttgtttttggtcatttcctcttagctttgtgctaagcgttgtttcaagaagctagttaataatagttttattttactagctggtattaagagaatcatgcaaattaactcattatcagaagaatcatatgaaatagatactgctcttatctctttttttttaatgaggaaatggaggcatcaagatcataaatctcagaactggtttaagtggccaagtagtctccatccagagatagctctcttaactctcaagcaggacggtctctcctaactgttgagataacgctgtggaagtgagaatacattaattttaaagaaatttcagtttgtttaattttatttttaatctctctaacctttttaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaaggtattttcctcctttaacatttataaaatatctcagatataacaaagtttttttttgattgttatatgtgtatttttttggaaatgctaaatatgagaatatttgaataatgagaaaatgtctagttagaatgaagtcctgtttaaatatagcctgtatgttgttgtggctgttgtttctctcttcattgaataagataatctgaaaaacttgtcagttgagcttttacagatgttaataatgcttgaagaatttaaaatgaggtaagaatatgatagatatgaaaagcttaaaattattttatatcttttaatagtacaaataacctattttcatagggtagaaaagatacagaagatataggtaactcttcccatctttttttcactcatttacttcaatcatattgtgaatttcatagaatagttaccagatttaccattgccttatcaaatctgagaaatttgtttttttttactcaggatttcaatttctggtctgtctttccttcctagaaggtgaagtcaagtagcttgctatctgcttccatatttaaaacatttcttatatgtaggaatatgcagtatatgtattgctttaataaaaaattaaaaatatttaaacatttatcatgctacctttatattttatgctcagcattaagaatataaaatgagagggtttttctttttatttcattctaaatatttaactgtgttattccagaatgatgaatttatagagtttaatgaagttagtgaagactacgcttcttgtagtgacatggaccttctgaatcctcgtaagtttgtaaatactatgagaattggtatgatgagttttcagaaaaatgattgttatagtaattttaatattcttaagctttattgtttagaaattgcaaagctcctagaacaaagaacataatgaacctacagactactaaagccaagaattgcttaactaaccagcctacttatttcacataacatagtgggtgaataaatttcagtgtacaaaattgaaaatttttagagatattttactgttttaatcattcgagaataatcaagtgctctaggatattaatgttggcctccaagtttttaaatttaagcttaggtaggtagtagctttctcatatgtaaataataatatgtaagagaagaaaacacatttgtcagtatctataaagtattgcaaacttcttccatgtgaatagttcactgataatgataaaatgggaaagatctgatattaggataggtcttttcctggtcactttactaggctactgatattttgcttagtgtgactgagcagcaagggtaagatttctgtttttcagtgacagctttgttttgattgttatgtatttttaaaagatctaaattttgtgccatatctatgattaaatcatagctatagaagagatgttttgtccaattgagaattcatcgttaagttaaatttttaatatctgtggattgttaacgttataaaatctttcagctctactatatgtgtaacaataaaataatatatattctagcactaacagtgtgcctggcacgattctaactactatattaactcatttaattcttgaagtaaccattgcaagataagtactatttttatattttacagttgaggaaactgaagtacagcaaaattaagtaactacagcaaaggtcacacagttattgaattgtagatcaaatttgaatccaggcaactgatctgaagttttttcttgactgctgcatatttggagcacatatcaatatcattgcacaaagaacaatttcagtgattagcttgttaagtataattatttgagatgctatttaaggcaactaaatttattataggctgcagatttcagatttggtaaaatgttgcctgttttatttatccattcatatatctattcaacaaatgttaatgcttgagtataagatccttgagagcaaaaactttatcttatggtctgcctgtctagcacacagaaagtatgtcggtgcttttatcaccagtatttgcatatagtagagtttaaatatttattcactgaaagaatattgaatgcttgtgatttgcaaaacattgcctttttcaagtttgattttgcatgctcaggcttatttttttttaatgacatgattatagaatatacctttaacctatttagaaaacacatggctaagttttttttttttaattttttaatttttttgagataagtgtggtcttactctgctgctcaggctggagtgcagtggtgcaatcatagctcactgcagtctcctagatgttaactccttggcttaaagtgatcctcctttctcagcctcctgagtagctgggactacaggtacgtgccaccacacctggataattttttatttatttacatactgtttttagtaaaacaaggtcttgctatgttgctcaggctggtcttgaactcctgggctcaagcaatcctcccatctctgcttctcaaagtactgggattacaggtgtgagttaacatgtccgggttcacatagctaaatttcaacaactgtgccaggactgaaagtaattaacaggcctctatctgaaatggattacagattatgattaggttgaatacctggtctcatagagtttatgatctgatctagattaattaaaagactcaagtttataaagacttacacattataccttatacatgctacttggaaatagggtttgatttcatttgaatgcagagagcaataatttactactctgggtttaggatcatattaaatcaggaatagtttttgtgaggttccagatttgttttgcctttatcaggaatacagtgttccatggggaattgtaaggcaccttaatgtcttggtaagagtgaattagcagaggcttttagggattggacttgtgttggataattttggagagggtttgaggaagcaagggctacgggtgctgtcagggagcaggagcaatttgatgattgatggtaagaatgaaatttttagcataaaataagtactcatgttaggcaaggggggctatatctgctcatttatgtggttacatggtgcccttgttttgtctatgttcggacatgaatggtggttttgggtgtgttgtttcattatgctaatgaagtgacctcatgtgatgttctttttcatgaaattatttatattcattagagggtacagtagtttaggtgttaattgccagacagggcaccaactgttagtgctccttttttatttgcttgtttgtttcgctttgttttgtgccttttttccctcagaggaaaaaaaaaaaaaaggtgtgctaccacagaagagtgtggtttgttcctgtgtgactagcaggaagggtacatgtgagcacctgaaggaagctgtagcagaagagtagaaagatcaagtcatggagtttatcccagagtcgtaggaagattttcagcaaggctaatattcttaggtttgtgtttcacaaaggttatcatcaaagcagaatagtgatttgttaggaaagtaagataggcaaggataatttgaagagaattttagtagtcattatttcagaataataatgagggtctctactaaggcaatgatagtgaggataaagagcaggtgatttatttgggagaaatttagatgttaaaattgatatgccttgatcctgatagatacaaaaagggtgaaggagagtaaggaaggtaacactgactacttgtgtttggctcatgtgattgggtaggtgattgttactctttaataaaataaaaaattcaggaagaggagaaggtttgggagaaataatgagttcacttttgaatataataaattatatatgaaatccttaagacagaatatctagaaatcagttggatacatacattggtccttgatttagaagtattggcttacaaattattaaatggtaaaggaccctactgattcccttcgtggaataaggtgataagcctccaaagatggcagtgaaagattagttgttacgtggtaagagttgggtagaagatttcatgtcccatacccccataatcttagaagtagaagagtccctttctttacagagacttcttagcagtcactactgaagtacataacaactggtgtcagggtccttgtgtcagtggccattgcctttcccctttcctttccaacctgaactcagttaccaattcttttctcaatcccctatagcacagctaagaaactattaatgtttaaacaagtaaggctttactaaaggttcaggatagcaataagaaaaaatatagaaattaatgtgcagttaactgatctggctattaaatatagctggtgttctgtaatggtccactctgtagcctctggaatcctctgtaggaataactatgaatagcctgccagcctgccaaataccagctttctcccaccatgaggcacactcttgaataaggttagacaccgcaaagtctggaccccaaaatggaagacaaagagagccattccttcaccctttatctgtcttcccggacctgtttccttttcctagggccccctcctctttttggaaagatgtccgaaatgttcaggacaactatctgtacccacagaaaaaaatccaagatttagtgcatagtagatatagttcctgcctaatttcaaattatttcttaaaataacctcttgtccatagctcctactaaaagatctgggtttaggtagtcttcagaattacaccctgtaatcttgacctccaggcttagctaattggattaagagtagacacctgacccagagaattccagttcaaagtgtgatgagtcaaattacattctctctcttagcatttggaattaggacaccacgagttagttagtcaaatgatattgagcctgggccgggctggccatgtggtggaagtttacgctgatgagtcagcagagaaagccattctacagagaagagctgagggatggagcaaatggcagaagtaggcaaaagagactgtggctctatgagagataaaaattagtcttctagttgtttcagttctcagtggtaatagtttgttccccaattaaggttgtctgtgtaggcttacaataaagctctctttatgtgaaccaatttaaatgggtgtctaatttttttttttttttgcattgcttttgcagccaaatgtattctgactgaaacacagggtttgtaggatttattacattatccgtaatcttctctaattgatatttttgtaggggagatgccatcattttgtcaaattaatattatcaggatatttgaaatgttaggtttttccgttttttagaaaaagaaatctgtggatcttaaatttttgcattacttattttcatatatgtcaaatcaagttagaatgtttcttgatttttaaaagatatatatggtcagttatagtaatagttgtcacttgccacagaacagtagtaaaaaaatttgtgaaatgcttaaatgttgctgaataaaagcatcatgacaaattcatggatactaattatttaatgtaaatatcaccattttaagaaaagaatacggtgaaaccctgtctctactaaaaatacaaaaaattagccgggcgtggtagctggcgcctgtagtcccagctactcgggaggctgaggcaggagaatggcgtgaacccgggaggcggagcttgcagtgagccgagatcgcgccactgcactcctgcctgggcgacagagcgagactccgtctcaaaaaaaaaaaaaaaaaaagaaaagaatatacatgattgattcaataggttatattttaaaataaattattaacttacctgtttattcaaactgattgctatcatgataataatactgccttttgtaatttttattgggcaatttttaacatctagatctccatatgaaagctgttaccttaagagtactaaaaactctttgatctatgcggatagccatttttaattaaaatagtatgtttttcttccatctgtaaataatatttttagatatttgactcttctgtgaaaggaaaaggtaatctaaaacttaatttcttcacagacagaaaaagcgaagtagagaggccagcaagtattcctctgtcctctggctatagtacagcatcatcagattcaactcccagagcctctactgttaattactgtggtttgaatgagatttcagaggtaagaaaatgcttagattatttcctttctaaatgaggaaaacaagcaagcattagcttttgttgtaaatattgctagcaagaaaaatagcaaacgcgaatcttagtctctcaaaattctttcataagtaaacagtacttaatgcaatgtttcaaactgtgttttgtacattctcggtccatctttgatgatggtttactttgagaaatcatctaaatttgttgctttttaaattaaaggaaacaacaatccagaaaatggaaaggatgaaaaaaatgtaagtaacagaaaggggcaacagaaattcatttctctatagggaattgtattggattacagtatatatagaatgtgcatgtgtgtttcaaaccttaaaggtctctcaatcaggtgtggaatttccttcaggactccactggataataaatccacctacagttatgtgtttgtgagatgagtcactgttttagtttccaacaagcgatttaaaacttgttggaattgttaatggaattaactgcagagagaatacaaagatatttttggttggtaactaatcaagagtattatctatttttgataactgatttatcaaaatattaaataatatatatagatggatggtttggagacattttcagtgttgtgaaaatatcactggtgtttttcggcaagttattgatgagatactaaaaatgatgtttttgtctagtacaaatggtgtgatttttctaaagagcagttcaaaggaaatatgaaatgaaattgcatataagatgattatgcagcctactactatagaaaattataatattatttagaaatgcaaaaagtacttaacttacacttcaagaatatgactcataatcgactcctctttgtcttccctctggtcatacttaagtttattcatagtaactgtacttatagataagaaaaatattcaaatttattttaggctaaaaagcataatttcaacaactaaaatgctatgctttattatgaattattgatttacttaatatattatttattatatttcaggtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatggtatgtatgtataattctatattacactgtcaaatataaaatattgttatatgagtagaaatcacttaaattttttttgtgtttgtgaatttgaaacagtgtaagaaatcacttttaagaaaacatttttagaattcctttgttttttttttttttctttttgaaacagggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatgggtgagtcaccatgcttggccacatttttagtattctaataaacagttggtcatcagaactttaaaatggtagcctacagaaacatacaattttgaatttaacagagtttcagtaaatatttccagaattaatgaagcatgttagctttaattttttcaattgtgagagaagtacatttataaaaattaagaggttaagaggttatagttataagggaaaaaacttctgtatcgattaactcctaaaatatcagtaccagcatggaattatagcaccaccttgtggttaacatgccagtattttaccttttgttaaaacaagtgatttcccatcaaacaggataatattttttcccttttgaaaaattcaattttaaaaagaaacatttttgaagttttcttatggaagatagaaaaaaagttaagtctctttctaccctttctttttttctttatatagtgcagatatacacacagagaagggacttaaaacatttctaatctcctagtttatatacagtgtgcaaaatataagtaagtatatattgaaaatataaaatatttcatatatgttatcaggtggaaatttagaatccaaattttcttaaactttaataacttgtctaacaactctctaatagggactaaaaatcaactcaatatatcatacatttacacttacaaagagtctttatctagacaacataatttttggaaaaataaagcaaattcaactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacataaccctaagttaagtaaaattttcactttcattcttttcattctctcataaactggttgaaaaaacactgtactaccaacaaaggtgtcagttgcttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctctactgtttttaatgtgatgttgtaatatattttaaaaataaaacttgaaaacgttgggactttgtttcatgccattcattactcataactttatataattgatacactcttcaggaagcataaaaattaatataaccttctcaattttataaactacaacactttttgagctcaaataacattgtaactttgatttttactttttaacagtccccaggtttgtctcctttctttgaaactgaaggcatcaaactgatcagcgtggaaggaagtgatgtttatcttaagtcctaaagagtgaacagaatatagccagggaagatggtttacgcaaaaggactagcataaacaaaggcttgaaaggaagagcatttgaaagaaattcactagggctagcatactgagtgtgctctgtgtgtgtgtgtgtgtgtatgtgtgtgtgtgtggctagaggtcagttgacacaggcccaaggggcagcttgtatcttatttactgaaccatttaagcagcagaatatgataaccagatctgagtttttgaaggatttattttaccgctttaatatggagaatgggtaagggggcaaaactagaggcagagaaatcagtgggagactattacagtaatcgaagaaacatagtaagagtgacttgaattatgatgacagtggagatggagggaaataatgggatttggagcaaatgtagtacttccagtttaaggactatcttcaatctagtatctggactgagagatagcaaaaagatactacactagtgtttaatctgttatcttgcctaattggttccgtctggaatcttgttagaagtgcaaaatctcaagccctgctcttgacctacttactacattagattcttcattacacaaagaacccaaagacatttgtaggtactttaagttcaagaaatattagtttacattcacatacttcttgttttattatcataactaacatttgaatctaagccttcaaattcagattctccggaattgcttttatctaaatatatacagcttcttgcaattcacatttagtatcttggcctccttagcacctttggttagcgttttagggttttgagtgcatttagttaaatgattttttttcctcagtcaaataatatataaataggaattaaaacatcctttcttcaaaattaggtgtaagctttgtacaaataacttgtttggtcctcatcaataatgattctttactaagcatgcacaattcataccattagcctccatctttgaaatatctgtgtttatgttgaaaaatttcctagttttttacttttaattatgttgcccaaagtacaacaggcaatattctgcatacatatttgtttttctctattatgtcatagggtgacttttctgaagatatggaaagcaattattagagatccatgtttcacatttaatttaaaattcagtattatatggtcttacaaactttttctgaaaatcatttgtcaaggaaatctcatttgagtagtaaaatgaagtaaatgaaggagtaaaaaaagcatcttaagtttaagaaaatacaatatttagaaagcagtttccatagatgaattaggtgcaaagagagcgagaggagaggaaaacagaaaccactaggagttcttaaactttacccaatcaatatgtatcttgcttcagatttgccatcttctgtttaagtaagctttgatttactgggtaagaatctgattattgtttttaaattctgatcattgtttgttgatattcacactaggacatttaaaacaacaccacagctgaggacttttaaatgaagatcagtaacaaacatcaaaatgtttaaaatttatttattttttcacactgccatgagaaagtagaaaaatgtttaaagtttaaaagcatttcagtattccaattatcctctcaatttcgcaccattttttaaaatcatcattctcttccaccttcactttttatatactatgcttttccactttctgaatgtgctgggctttccatgactttacaaatgctcttccatcacctaaaatgttcatttgttctccactcttcatttcctatcctctgcaccacattggctggtagaattctactcatcataggggcttcagattaaacataactccctccaaataatgccccctaggtccctagaatagtttagattccctgtttatgctatgaaaagcaccctgtaatttttcttcatttcggtttgtacattataaacctactatttgcaattgttgctcaaggttgtcctccctgcgaaactatgagtgttatgtgaaaagagatcctgaattttgtttactgatgtattctccatgcttagcacaatgcttggtacataggacattctcattttattttgtggcttgacaaacaattaagatgtcctcccatcccccatattatgatagaattcaaattttgtaagcaactgttagctgatttttaaattcaatatctgaaattaatttcattttaatgtcaactttattgttatactacatttctgtatttggtcacatatttaaatgtagaatatagtatgtagcattaatgcccaagttggtaacttttaaaatagtttctccatactttaagcactgatatttttgagcctaaatgtgagattttcctaataaaaaggtgaggaaatttaatgatatttttgaaaagttactcaaaaaagtacacaggtctcatttaaagcactaaaaggcagcaaatttttagagaaaatgatatttctgtttgcggcaatatggcatacaaggtattaaaaaatataaaaaactcctgcaacaaatcatcaaacattcttgaaaaaaatataataaatatttatcacagatatcacaggaaattaaaagaaatccctaaaggccaaaagaagaggaagcagaaattcagagtattatgcttgcctgaagcagcagctgccctgagagattgttgatattagaaactaaggccttgagaggttttcccccctcatgtttctgcatcagcgtttattgtgttataatttacatacgataaaattcaccaatttcagtcatacattcatatagccaccaccatatttaagatatagaacatgcctctttgcagtcattcctctgataccaaaccaggcacattctgcccatcctgcagtaagccaatcactgagacaatgagttttgcagtggagaaaagattttattcatgaggcagccaagtgaggaggtgggataacacccctcaaattctcctccttgaagttggggcattagggatatttgtgggataaaggagcaaggcagtccaatgcatggaaaaagttaattggtggtaaggaaaagtgaggtaattgctgatctgtgcgagtgcagttaagcttcatggcttttcataggatccacgttcgcaagatggtgtcgttggcacaatctgagggtggagtttttggccttctgatgtcaaaagggcactcattgggcattcatacaggccattggaggctcagtggagtcagcttgaactggacaagagctgatcctaatttcctgaaaaacaagcaactattaattactatggtgacctgtacatcagagatgttatctataaggaaactagtggaagtttagttacatattgcttagttgcattgacttttcgctatgtaggttttaaaatcaactagaagcaagcgactacaaacaaggcaagttaagtttgataggcctaattaggttagccctgggtttcaccttgtccttcagcaaccactgatttgcattccatcattttaatgttgctgttgctagagttttatattaatatcatcataccatatttagtcttttgtgtctggcttcttccatgtagcataatgcttctgagattcatccatgttgttgtatgtagtagttcattcctttatatggccaatgaatatttcagtgtgctaacataccacaatttcatcagttgatggacattgtgatatgtccagtttggaggtattccattttataaatctgctatgaacactggaacatgtgtctctggacacatgtttttacctctcttgggtaaatgcctaggagtgggatggctgggtcaaatagtaaagttatgattaagtttatgaaaaactgccaaactcttttccaaactggctggcccatttgcttttcccactagcaatgtatgagagtttcagttgctcagcatccataccaacacttgattttgtcagtcttctagtggacgtgtgtggtgtaaaccaaaagttaaggctcaatgttatgtactgtcttgacatctggtaaactgagaaggtttcaaatggcctaaccagaggatcccctcctcactctccttccatggataaggtaccctagccaaacaaccactccttaacagagggaccagacacttacccctgagtagcagggtttcagttccatgccagctgtgaaattgttccaagaaaccaatcatatattcctgtgggaaccaggggatgtctcaccctcttcatattacaaagtctgcctcccacatctcccagctgttctctgttcccaaattcaacccccatagagcaggcagtgtcctcccctataagctgtgagtacatatgactaataagctgttatcagtttcatctgcgttgtgctgggttttgtgttgggccttcccataaccctaggtgggaattcctccctcaccaacatggtgaatggggggtgattaaaacagtgtgtaatggtctctcatcgtagttttagcttacatttgtccaaaatgttgagcataaagtatttatttgccattagtatatcttctttggtgaagagtctattcaaagatattcccaattgtatttaggttgtttgtcttcctgttgggttgtaaagggcctctattgaacagttttgcaaagattttcccccactctgtggtttctcgttcatttcattaacagtgttttttaaggagcagaagttttaaatttttataacatccatttataaatttattcatcactgagagaggggtgtagccatgtacagtcactcatgcctgtaattccagcactttgggaggctgaggtaggagaatcatttgaggccagaagttcaagaccagcctggtcaatatagccagatcctgtctctacaaaaatttttttaaattagccaagcatagtggtatgcacctgtagtcctagctactcgagaggctgaggtgggaagataacttgagctgaggaggttgtggcttcagtgagctatgaatatatcactgcactccagcctgggtgacagagcaagaccctgtctctaaaaataagaaaaagagaggtgttgaagtctccaactagaactgtagatgaagactaaaaaacttttattttttctttcagttctatcatgtatttttaaacctgtttttaaatgcataaacatttaggactgctatttcttcatgataaagagacttatttcttattatgagttggccctctttatctctggtaatattctctcctgatatctatgttgtctgacagctattccagatttctcttaggaagtgttactacagtatttatttcccatctttttacttttaatgtatctgagtctgtgcatttaaagtgggtttcctgaagataacgtaatttggtcttgctcttttatcaaatctaaaaatctctggaatgtttagattatttacatttaacttgattatggatatggttcaaatctaccaccttcttatatttgttttctgtttttatcatttgttcttagctgcttttttgcctcttttcctgaattatttttcactggatattttttaatgttttttatttttttcttggcttatgaagtatcctgtgtgtgtatgtgtgtgtgtgtgtctgtgtgtgtgtctgtgtgtttgctccaagatttgtagtatatatatttaacttactataagctactgtcaaatattatactactcatttttcagtatatatatttaacttaatataggctaccttcaaatattatactactcattttaagtataacataagagccttacgataatatacttttcattctttctgcgcccgccaagcctttttttgtcaaacattgacttctacatatgttataaactgcaaaacattatcattacttttgctataagcaatccattatctttttaaaaggtttaaataattttttaaaagtcttttatatgtgccaacctatttaccatttccagtgctatttattctttcatgtagatccacatttcttcttgatataattttccttctgcctgaagggtttcctttaacttttcttgtaatactagttgctggtgatgaattctggaaaagtctttatttcaccttcattttcaaatgaaggatacaattttaggtgaatagggatttttggtttttttgtttgttgtttttcattcttttcagtaatttaaagatggccctccatggtcttttggtttgcattgtttctgatgagaaatctactgttatttttatctttgtttctttatggaatctgtctttttttactttgtctgctttgctacatttgagatttctcattaccactgattttcagcaattagaagagctatgtagaaaaaccaaaataaactacagacagttttttagaattaatagaatttggcacatttttagatatgagatcaatatatccaaaccaattttacttctagataggagccataagtggacatttacatatatatgtatatatatatctacatatatatataagtagtatgtgtgtatacgtgtgtgtgtgtatatatatgtatatatatatttagagagagagagagagagaaaaaacagataaatggtatcaaaaaaacaaacgtaataaaatatgtgcatgaactttatgtagaaaattattaaacttatataaattaaaaacaaaatattaaagaaaacctaaataaatgggtagacataccatcttcgtgttaggaagactcaatacagattaattcttacccagattataattttaattcaagtaatctcaaagtcttgacagttttttttcccccagagtctaagattatacatattaaagaagagaaaaatagaaaaggtagctaagacaactttgaggaagaaaaacagggtgggggatttgtcttatatttaaaattatttcctaattgtagcaattataacaataattaaattttttatagcaattgttgtagggcaaataggctaattgaagagtacagagcccccaaacagactctacagaatatgatgtatgacaaatactgtattactgactgtagtggggaatggatagattattcagtaaaaagttctaggaatacctggctatttatatggacggggtgtgtgtgtggtgaatttagtcttgtttcacaccattcacaatcattttcaggtagattaaagacataaatgtgaaaagagaaatgaaaggactgtaaacagtaatatcaataccacctacaagctaaatctgcattttgaaaacttttcaggtgattatatgaatattaaagttggagaaacactggtaaaggagatttatctttataactttgggtgggaaaatagtttttaaaaaacacaaaatgcacaaaccataagagaaaaaataaatttgatattaaaattaaatacttcaactactagctaaaagatagccttttcccagaagttgtcccaaataggtgtcagaaagcttaacttaaactggcttaagcatgaaaggggatcaattggctcattaatctgatgaccaagggggaactgtagacaatccagaacccaacatttccaccaagaagtaggaaaaggagaaaacatctaagttgtggccatgtggccgttccagtcccaaagggctgactggttggataacggaaagaaaggaagaggatattgctgttttgagtagatgatggttacctagaatgttggcagtagtccagaagataactcaatatagataaggaacttttgctagtttttctaagaaataaattttgtatttccatagtaactatcagaagagactggaattgatacagtgatttgtacttgaatgaaaagctgcctcgtagaattccaggaggaagccaatatctcgaacagtgcaattataagacagtgtttgaaatgctggaggaagcttcagtcaaagccaggcctacctatggacttttcagttccatgaagcattgattagagtcttatggtgtatccagaaaattgtctgtaatttttaggagcaactcaaacttatttctttcattttttttccgtcatggcaaagaatttctcaacaaatatgattttttaaccataacactttgacatatataaaagatattgttaatttacaactcaggctaattaaattctgcatagaagttatcaattatgcttaacttttcaagcctaaatcatcctttaacaatataaattaaaataggtttctattctgaaattacatagaaaaacttatgataaaccattaacatttaagatcagtgtgtacaagagtaatggcaatacttttccttttcttttttttcttttaagacagagtctttttctgtcacccaggcaggagtacagtggcacaatcatagctcattgcaacctagaaccccttggctcaagcaatcctcccacagcagccacgtgagtagccagaactacagatgtgtgccactgcacctggatttttttttattggtattttttcggatttgggatctcactatgctgcccaggctagtctcagactcctggcctcaagcaatcttcctacctcatcctctgaaagtgttgagattacaggtatgagccaccaagctggccctatacttttccattttattaggaagatgattcaggatgaataggaaaatatcatgggaaagccctttgctcaaacacagacacacacacagacacacacacacacacacattttaataggagttaattataagaatttttagaaaagttgttagcactttccctcttagtacagttttaagttggttttacattgtaaatgttaaggaaacgtgtttaaattgttttgatatgccttcaaagttataaaagttataaagttgtcaatgttgaaatatatttggtattttagcattatcttgcttccaggataatgttctcacactttatagcttgaagaatgtactttactcatgggaactaaaaatgttatgctttgagaaaccaaaggggaaaagttcaaaaggtacttcataacttttttttttaggtttagagaaaggataagactgtttggattatgttcttctctaatttagttaaaaaaatattaatgaatatatgttaaccttcaggctatcatcattctttctcaagatagatttatggtaaaaatagactactgaactgtcttgttaaatttttaaagatgagtttggatgagttgcaaataacatcctctacccttaggtcaaaaagaatatgtaaaccaaaatattttagataggaatacttattatagtttcaactttcatacttcgtattaaaatgattgtataagaaaatacaatatttttaatgtttttattcagaatatgttctgaatttgtaacacatgttcattttttaattgttcaaagtaacacacattcattttattgtcattaaaattttctttaaaagtcaaagatcaagttgtacccagaaataaactttgttaatattttgacgtatcttattttcttattttttctatttatatttatgtagattttgtgtttattaaaaatgaagattggctgggtgcagtggctcacgcctgtaatcccagcactttgggaggccgaagtgggtggatcacccgagctcaggagttcaagaccagcctggccaacatggcgaaaccccgtctctactaaaaatacaaaaattagccaggcatggtggcgcgtgcctgtaatcccagctactagtggggctgaggcaggaggatcacttgaacctggaaggtggaggttgcagtgagccgaggtcataccactacactctagcctgggcaacagagtgagacttcgtctcaaaaaaaaaaaaaaaaattatgtgatacatgtaatttttattcttttcatggaaatcatgaatattttccatatcattaaatatattttcaaatgcaaaatatggattttaataactacaaaatattctttcctagaagttcaacaaacatttaatcttttatgtgccaggcataacaccataatcttttttattatagcatgtgtttttttaattaaaaagaagcatttcaaaacattttcttaatatacttctctccagggattatgccaagtatgcacatgaaagcctgtttctctttgatcaagggagctagaggcaactcataatctaatagtcaggggttctcagaattcattctcaacctctttattaacctactaaaaatatttaccataatcttttaaatcattttcctattgcatattttgctggtttataaagttcgttaatataaaaagtaccatggtaaacatatctacatgtaaatctttgatgatatgtattattattttaggatgtgctttcaggatatgcagtggttaaggcacttgatatctactgatgtctttacacccataaaaggtatacttttctataggaattgttgtttaagtgtatgctcatcacaatggagtattttcatttttaattagtacgtaaattagatctcataattatgttaccaattttttaattaaagtaagacaattgcatagatttcttattgccatcactcctcaccaatgagaaaaaaaaaaaaactctgaacatttagctgtttattctggtatctaacaacatatttctaaataatatgattgtcatttctctttgtttgcttggtcttctttaggcattattttcagagtacctattatggaagaggaggaaatattaatagcactctgacactgctctaattcctatctacccattctgccaatgcatttagatcatattttaatgtataattttgtgtttcctttctagaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaagacctctatttctctgttgattacatacacagtggcaatggaaagaagggaaaataatggggatagcatttgctcattctctgaccatgcaacactggcagcattctatacttattctattaactgcatcaaccacatcttataaaacacatttccataggccatatgtaataggccttggctttattcattgcatttattggctccttaaattgacaacatataattgttttcatataattttcatcaaataaaattcactttaatttgtatgaacatatttaaagtggaaagtatcttcccaaatggtccatatcttaaagtgtcagatattttatgggcttcacatctgaactgccagagatctcaggcatagcatgcattaatcacaaccacttactgacctggttcagatacttactcaatacatggggctagacacagagtgtgccttaggctaaagaaaaaattattcaagttgagcatatccataaactctggctcaagcagtgtattttgggggtaataaacacaagtttgttcctagttggagggatatgatgcttaggtttgaacctgttaaccttcctgggtttgagggctagaaaacgtggagacattcctttctaactaacacattttctaatagaaacaatccaccaggatgttgagcccacattttaagagttcttcggaatttactgaaaatggaaaactgattacattgggcacataggacatttatatttatagaaacattttagataagacaagaattttaaaagccagaaatcacttttagtgggcattttcagaaaaatgttgtcaactttttgtaatttttaataggcataaaaaagattgttatattgatattgacagaaattaggtggttaattagagagcgtaaaaggatgaattgctctaacattggtttagaatttttctttatatgattcaattttgtggtctggcaaaggcccaatagtcatttatctagtatgcatacctttccacagctggattttcaaatatgatgataaagttcatatgacagacctattctgaaaataaatatgtcagcaggctttgctttattttatgcatttattctggatataacataacttggtacaaacacagaatacaatttaagacattttgccagagctcttcaagtatagcatcgtttgagattgtggaaggtgatttagaaacacctgggttgagtatttatatcccagccttaaatcctaaaagccttgccgttttatagtcctttcggggaaatacaggaactacattaatacttgttagtgtaaaagttaatgcattgctggaaaagccttgtaaaaaatcagaaaattatgcaaaaaatgaagggaagattaaaaagggtagtgtttgaccagcagttataggtttagggatgtatttttttagaatatatttttaggaatgtatccttcaaattttagggtttgggggcataatgagaagattcactggaataaaattctaaatcttatatgtaaatgagcatttttgttcatagtaatatttaatggaatgtggctaagagtcctatctaatggtgaaacaaaaatgaacaaaatattctcctcaagctctatgtggtccttctgttacctctgtctttttaatgacactgttctcatgctctccttcctcccttccttacatctgtttggtccaacttgatgccacacaagacaaaaagcttatttgatggaagaatataagctgatagattagtagggagaagaaccataaggtttcctcctctcttcttgggtaatatgtttacattaacggcagtcatctagaggagcacctccagcttccctatcagagagagtgattttcagacagtgtagtaggagagcaagcagcactgtagctcatgatgtaaatattttctcagagtggaaattttatagcctaccagataacatgttagctgcgtaacctgtcatacttttgaaaaagtcccttcacaagataatctttatcaataataaataataatagtcattgctaacatgtttgagtactttaattactctggccaggcacaaagtggtttacatatattatctcatttgaatctcccaacaatcctattaggcaggtgcttttgttatctcattttatggatgagatatctgtcaattctcttttgtgattaacgcactacctctaaaattagtggcttaaaatatcaacccatcatttaactcaagattctgtggattgatgccttgggtgcagcttagctggcttgttcttggtcttagttagccaggaataggtgatcttggctgagctctatgaacctgtgatcagctggtgagccagttggggcttgactggtctataaagaccttagctaggtcctactccaacagggcctctccccacacagtttctcattctctagcctgctagccctggcttgttcatgtagtagtctcacagtttctaaagctctcaaatggaaactgcaagacctcttgaggcccaggcgtgacactagcataacctcatttttgttgcattctgttggtcaaagcaagtcacgactcctaccaggttcaaagtatggggaaaaagactccacttttcgagaggagtgtctttgtgagtatttttacatttgtttctgactctaagagatgtgtcatgacttgccaaagatcacacagttaataaataaaggaattgaattcaaatccacgtggtttgaggccattacactgcataattcagcattgtgtttcaaatgtcattgttaacccttgacctcttcctcccttaatgctaagtaaccacatcaatttcttattgtaaattctctttaaaatgttactagtagctttgactgtgcaaactgcaaattgttaatctctgcaaaatctaatgggtctagaccagaatcttgtagactctccatgagtcttaagagttcatcaagtctcttggacaaggaagggtgtcatatctgagactccaactaatgacttactaactcacttactaactcatctcttcagaatggtctctaggattggaagctaaatgtggagattgagagtagcttttgggccaggcaatggaaaccaaataaacaaaatgagttaccaaataccctttcctacattcagttcccttcccatcattttgatcaatgctgagtctgtttagtccaggtgcagttttatttactgacatcagtggcctggaatcatcaggattgccttatagttattggttttcattttgaatcccagatgactatggtttttccctcgattatttaaccacacatttaattcaagtcttattcatgctcagtaagttagcttttaatatctccattttccctaaatctgtgagcctggggcattgacatgaaatacttctaggacccaggcttttaaaattggaaatatggttagctgcttcttatctcaaatttcctttccctataccttggtgtactagtgagcatttttttttcaacttagacttctagttttctttttgagtaagaaaaaaaaatgagctgaagtagaattcttcttttattcattgccgtgccctttagtggttcctgtactgtgtattttggagagttacagacctcaggagtcagcactggatcttaggcagtgataaaagctactgacacaacagctattttctccaacaagtccaagtgcttttgcttttgattccctacttcgtgatgttagcagtgagagtggaagaacagtctcaaaaaagaggtcagcttctttccagagccatttggtaaaaatagggaatgactgcagtttggatttttcaattcgtcactctgtctagaaatctattctttaacaaacccctggttctttatattttcacagatggggaccatatttattatttattgttgtgcatatctttttttaaattttttttttttttttgagaaagggccttgctttgtcacccaagctgtagcacagtggagtgatcatagctctctgtagccttgaacttgtgggctaaagcaatcctcctgtctcggtctctggagtagctgggactacaggaatgccaccatgccccgctcattttttattttttttagagagagtgtctcactatgttatccagactggtctcaatgctgatctctagcaatcctcccatctcagccacccaaagtgttggaattacagtattgagccaccatgtctggctgtgtatatcttgtagatttctaccaatagtgtatgtgtcacttattaaaggccaagcatcattttaagtgtcttctcaatacttaatttatttaacatccatataataatgtgctgcaatatacattgcaggcttaaaaatgttcgtattattaaaacctggtatctttatattctgaaaaaaggacataactagatatacctaggtatgcattgcagacctattgataacagagaaataaaggaaacattctattaagcaacaagggaattgcagtcactcataccgtgtgtataaaggatagtggctgcagtagtaaggcaaaagctagacttgaatactttatgtagaatatagaataacatcttaaaagcctacagacatacaccaacatgttattctgggacatgagaatatgggtttctttttcttttaaatatttacatatttttctgttttctaaaattaacccactttttttgatattttactgaacaaaaattatatatgtctgatatatatcagatatatatctgaatttgtttcagataattcaaatatatatatatatatatatatatttgtttgtttgagatgcagtcttgctctgttgcccaggctggagaacagtggtgcaatctcggctcactgcaacctccgcctcccaggttcaagcgattctcctgcttcaccctcccaagtagctgggattacagttgaccaccaccatgcctggctaatttttgtatttttagtagacatggggttttaccatgttggccaggctggtcttgaactcctgacctcaggtgatccaccctcctcagcctcccaaagtgctgggattacaggtctgagccactgcacccagccaaattcacgtatattttttgatatatcaaacatttgtattataatgataaaatagtttattaaaaaagataacatttgcagaaagtacagaaaaaataaaaagatatgtgaaaccatcatttataatctcactactgtgaagtgtaagtactgttattttctcatattacctcacattcattttttctatatatcattatatatatgcaaatgcacacctacacatatacagacacatatatatacaaacaattttgattcctaaagtttacctcatcattaattccatattgcaaaaaattcttcataaatattttaattgctacaaaatatttcttggtacaaatgtgacataatttgtttcctctcttattagacttttgtgttgtttttaatttttgattttataaaaaatagtgagattaacatactttttgataactttttgtctactttaaaaaaatatttcccaagggaattgttggtggctttctaatcaccaaacccactgctgtttgtcagtcctcatccttcacatcgtttgcactgcttgcctgatgtcggccacctcgtcttccttgtcacatccctcttctcctatggctttcatgaaacagtggtttcctgattttgccactggtctaacacctttctcagtttcctaaaggtttgtttttcattgtacttttctaacttgatggtcctaatatttgcaattcaatctctttttcagttctcatctccctcatccctaagccatgttttttgtttttttttttttttttttttttttttttgagactgagtcttgctctgtcacccaggctggagtgcagcagcaccatgttggctcactgcaacctccaactcccaggttcaagtaattctcctgccttagcctccccaagtacctgggactacaggtgcctgccacgcctggctaattttttgtatttttagtagagacggggtttcactgtgttagccaggatggtctcggtcttcagatcttgtgatctgcccaccttggcctcccaacgtgctgggattataggtgtgagccactgtgccaggccaaccgtaaggttttttctttttcttttttttttttttgagatggagtctagctctgtcaccaggcttgagtgcagtgatgtgatctcagctcaccacaacctccgaccccctggttcaagtgattctcctgccttaaactcccaagtagctaggattacgggcatgcgccaccacacccagctaatttttgtatttttggtagagacggggtttcaccatattggccaggatggtctccatctccttacctcgtgatccacccgcctcagcctcccaaagtgctgggcctataggtgtgagccacggtgcccagccagccctaagcttttatgcttctatgaggattgctagtacatcttttctttgagctttgaactctttcccattctctagattttcatttctccttgctgcagatggccacttcaaattcaaaatgtttgaaatgggaagcaaatttaccaccaagtcaaccttttctcctgttatattaccctcttatttctacctataacactacagtgcttccagtcagcagggcttgaacttggagtcttttttaaaaaatggcttacttgagatgtaatcaaactttacatattgaatgtataaagtttggtctgttttagaaccattgcaaccatcaagatgatcaactctatcaccccaaaagtatctttaagttctttttaaatttatttctctctctagctccatcctgaggcaaatgctgatctaatttctgtcactatagatttcttttcattttcttgagttttgtatgaatgaaatcatacagtgtgtactcagcacaatgatgtggagatttatccacattgttgcatgcattcatatctttttctttttattgccaaatagtacgtcacacatggatgtaccataatttgtttatccattcacttgttgatgacatttggattgtttccaatttttgatttttagaaataaagctgctattaacattggtattgtaaaccaaaaagtacctgagacaagtcttaatcaatttaaaagtttattttgccaaggttaaggacgcggccatgacacagcctcagaaagtcctgatgacatgtgcccaaagtaataggctacaactgggttttacacatttctgagagacaaaaaacatcagtcagtacatgtaagatgtacattggtttggtcccgaaatgtaggacaacaggatgtggaggcttccaggtcataggcagattaaaagatttttctgattggcagttggttgagttatataaagacctggaatctaatctgtcgtgggagttttaagaaaagtaaaattaaaataaagacctggaatcagtagaaagaaatgtctgggttacaataaagggttgtggagaccaaggttttatcatccagatgaagcctccaggtagtaggcttcagagagaatagattgtaaatgtttcttatcagacttaaagagccttttctatcagttttaaggtctgtgttgatgttaatggtattgaggcacgtctgacttctccttcccatcatggcctgaactagttttacaggttaactttggaatgcccttggctgagaggagaggtccattcagaatgtttgcgggcttagaattttatttttgatttgaagtatacaagtctctcgagtaaatttctaggaggtaagtgtatacttaaatttcaaagaaactgccaagctgtttccgaaagtagtcgtacaattcctatcagcagcatgtgagagtatagttgctccatatcctcactgtctttatccatttatgatactataacaaaatgttccagttctagtacacatatatacatgcagaatatataacaagcagaatataatcttttatcttttaactttaatcttttctgactctattagtccgttctcacgcagctaataaagacataataaagactgaataatttataaaggaaagaggttaatttgctcacagttcagcatggctagggaggcctcaggaaacttacaatcatggcggaagggaaagcaggcatgtccttcttcatatggcagcagcaaggagaagtgcaaagtgaaggaggggaaaagccccttataaaaccaacagatctcgtaagaactcactcactatcacaagaacagtatggaggtaattgtccccatgattcaattacctcccaccacattcctcccacaacatgtgggaattatgggaactacaatttaagatgaaatttgggtggggacatagccgaaccatatcactgatcattgagtatattattaactttctacgtagattcaatgattcagcttcatattattaactttctatgtagactcaatgattcaactacttaaatatgtctaggctactaataaaccttcttgaatgaataacagatgaacaactgaatataaatgaaaacagatggccataaagaagaggattcagaattgtcatcagcccttcacaatcactgcattttctctaataagctcacatgcccatagcacattgccaaagtttattgacttcttccagaatttttatataaaattatgattatgatctcatagagttcaggattgcttaccaaagagcataccctcaccaggatgatgccctttcaaaggacctggtgccccaaggagcactgggggagggaggcatacagatgcattgcatgacattcttaacctaaaccctgctttatgatctcagaatcttccaaacttctagtccttccagatctgaaaatctgtagtcactccatgatccagagacagaaggcaagcagaatttggtatctggataccaaacactgatgttgtgttgtgaatctttgttatcaagattcttgtgcctttaaattacgtatttgtggatttgacctattgagatatatcaatattcctatgcatatatacatatttgcccaataaatcttttgataaacaaagaagggtagtataattcttagaaaacagtggtttctgctattgagctatttgctttagatttgatgtgtctataaatggctatacaaaatatgttttaagtagtgataatagattagatattaagcaactgaatgtggcagctaggactaaggtatattaccaagtttttatcttcattgaacaaatcatagaagaaagtggggaattcatttcatacctttctctgtatatactccatattgatttaactacttaaatcatctcatgggtatataactcttatttcatctatatctttttttccctgactcctctgatagcttaggagagaagaaaggtatgttcagaggcatatgcaaagacctgccagaacactcacaaatggggtgatgagagtaacggggtagtgagaagcattaattttgtatagaagtcagatatacaagcattaaaatatatgcctattataaccacttaaattatggttcattttgatagaaaaaaattctgctgaaaatctaatttcaggcagttgttcaccaagcagaatcatagtaactatcttatctgtgctttctatgtatttatcttgctgactgattgtgcttgttatggtaatcatttactagtcactctatgtaatgtctcacaaactgtaacttgaataaaggcaagttattagaccttagtaccaaaaagtatttgaaaattcagagtgcttatctcttcctttataatatctgacttcatcaggaggattgcttgaagccaggagttccaggccagtttggtcaacaaagccagactctgtatagaaaaaataaggaaggacggaaggaaggaaggaaggaaggaaggaaggaaggaaggaaggaagggagggagggagggagggagggagggagggagggagggagggagggagggagggagggagggagggaggggaggggaggggagggaaagaagggaaggaaggaaaagaagggaaggaaggaaggaaggaaactggtacctacaggcagaaatgcttcttcaaagaagcctaactctgcatttaattttaactgattgaataagacttacacatattacctatgatattcaataatttcccttactagagccaattgattacaaaccttaatcacatctaaaaaataatatcttcatagcatcacctacctaagtgtttgtaagtgggaactgtaatctagccaggttgacacgtcaaaagacaatcacagttaaattctcagaaatagaatagctgaatcgaagagagtaaatttttatttttttcaatgttttttaaattatagacaatttttagagcagtttaagcttcacagcaaaattgagaggaaggtacagagttatctcatctacctcctgcccacacacatgatagctccctcattatcaaagtcctccaccaaagtggtacatttattacaactgatggaactacattgatacattatcgtcactcagagtctatattttagggttttttttaattttgtttttggtgttggacattctatgagtttggacaaatgtggatatgaatgacatgtatccattattatagtatcatacagagtattttcactgtcctagaaatcctctgttctccacctattcatccctccttccccaaaccccttggcaacaactattctttttactgtctctataattttgcctttaccaaatgttatattggtaacatacagtatggaatcatacagtatatagcctttccagattttttactgtctctataattttgccttttactttttactgtctgtataatttgtctttaccaaaatgttatattggtaatatatagtatggaatcatacaatatgtcgccttttcagattggctttttttttacttagtaatgtgcatctgaatttcttctatgtcttttcatggcgtggtagtttctttctttttaacaccaaataatattccattatctggaggtacagcagtttatttatccatcatctactgaaggacatcttaattgcctccaagttttggtaattatgaataaaccagctataaacatccatgcataggttcttgtgtggataaaagttttttattttttgtgctaaataccaaggagcatgattgcggattgtacagtaaccacgtttagttttgtaagaaactatcaaactgtctttgaaagcatctgtcccattttgcattcccaccatcaatgaatgagagttcctattactttataaacttttcagcatttggtgttgtcagtgttctgaattttggctattctaataggtgtgtatctcattgttgttttcatttgcatttttctgatgacttatgctgtaaggcatcttttcttatgcttatttaccatctatatgtcttctttggtaagatgtctgttaaggtctttggcccatttttactgtttgttttcatatctttgaatgttaagacttctttgtatattttgggtaacagccttttgttaggtatgtcttctgcaaatatttttttccagtctgtggcttatctttcattttcttggcagtgggctttaatagagcaggcatttttaattttaatcaaatccagcttatcagttctttctttcatgaattgtgcctttggggttgtagataaaaactcatcaccaaacccaagatcaactagattttctcctatgttgtcttctaggaactttataattttgtgttttacatttaggtctctgatctattttgagttttttgcaaagagtgaaaggtttatgtctaggttcatttttttgcacttgcacgccagttggtccagagccattggttaaaaagaatgatacatattttaaaattccttttcttttctttttttttttttttttgagatggagtctcactctgttgcccaggctggagggaaatggcacaatctcagctcactgcaacctctgcctccagagttcaagcaattctcctgcctcagcctcctgagtagctgggattacaggaactcgccactacgctcagctaattttttgtatttttagtagagacagggtttcaccatgttggccaggatggccttgaactcctgaccttgtgacctgcccgtcttggcctcccaaagtgctgggattataggcatgagccaccacgcccagcctttgtgccagttttcaaagggaatgcttccagcttttgcccattcagtatgatattggctatgggtttgtcataaatagctcttattattttgagatatgttcgatcaatacctagtttattgagtgtttttagcatgaaagggtgttgaaggccttttctacatctactgagagacttatgtggtttttgtcattggttctgtttatgtgatggcttacgtttattcatttgtgtatgttgaaccagccttgcatcccagggatgaagccaacttgatcatggtggataagctttttgatgtaatgctggattcagtttgccagtattttattgagcattttcgcattgatgttcatcagggatattggcctaaaactttctttttgttgttgttgtgtctctgccaggttttggtatcaggatgatgctggagtcataaaataagttagggaggagtccctctttgtttctattgtttggaatagtttcagaaggagtggtaccagctcctctttgaatttggctgtgaatctgtctagacatgggctttttttggttggtaggctattaattactggctcaatttcagaacttgttgctggtgtattcagggatttgacttcttccttgtttagtcttgggaggttgggatggtgtttatgtgtccaggaatttaccatttcttctagattttctagtttttttgtgtagaggtgtttaaagtattctctgatggtagtttgtatttctgtggaatcagtggtgatatcccctttatcatttctattgtgtctatttgattcttctctcttttcttctttattagtctggctagtggtctattttgttaatcttctcaaaaaaccactcctggattcattgattttttttgaagggtttttcatgtctctatctctgtcagttctgctctgatcttagttagttcttttcttctgctagcttttgaatttgtttgctcttgcttctctagttattttaattgtgatgttagggtgtcaattttagatcgttcctgctttctcatatggacatttagtgctataaattccccctaaacactgctttagctgtgtcccagagattctggtatgttgtgtctttgttctcattggtttcatagaacttatttatttctgccttagtttcattatttatccagtaggcattcaggagcaggttgttcagtttccatgtagttgtctggttttgagtgagtttcttaatcctgagttctaatttgattgcactgtggtctgagagacagttataatttctgttcttttacatttgctgaggagtgttttacttccaattatgtggccaattttagagtaagtgtgatgtgctgctgagaagaatgtatattctgttgatttggggtggagagttctatagatgtctgtaaggtccacttggtgcagagctgagttcaagttctgaatatctttgttaattttctgtctcgttgatctgtctaataatgacagtggggcattaaagtctcccactgttattgtgtgggagtctaagtctctttgtaggtctctaagaacttgctttataaacctgggtgctcctgtattgggtgcatacatacttacgatagttagcttttcttgttgcattgatccctttaccattatgtaatgcccttctttgtcttttttgatctttgttggtttgaagtctgttttatcagagactaggattgcaacccctcctttttttttgctttccatttgcttggtaaatattcctccatccctttcttttaagcctatgtgtgtctttgcatgtggcatgggtctcctgaatacagcacaccaatgggtcttgactctttatccaatttgccagtctgtgtcttttaactggggcatttagcccttttacatttaaggttcatattgttatgtgtgaatttgatcctgttattttgatgctagcttgttattttgctcattagttgatgcagtttctccatagtgttgtttttctttatattttggtatgtgttttggagtggctggtaccagtttttcctttccatatttagtgcttccttcaggagctcttataaggcaggcctggtggtaacaaaaatccctcagcatttgcttgtctgtaaagggttttatttctccttcacttatgaagcttagttgggctgaatatgaaattctgggttgaaaattcttttctttaaaaatgttgaatattggcccccactctcttctggcttgtagggtttctccagagagatccgctattagtctgatgggcttccctttgtgggtaacctgacctttctctatggctgcccttaacatttgttccttcatttcaaccttggtgaatctgatgattatgtgtcttggggttcctcttcttgaggagtatcttagttgtgttctctgtatttccggaaattggatgttggcctgtcttactaggttggggaagttctcctggataatatcctgaagtgtgttttccaacttggttccattctcctcatcactttcaggtacaccaatcaatcgtaggtttggtcttttcatatagtccaatatttcttggaggctttgttccttcctttcattctttttttctctaatcttgtcttcatgctttattttattaagttgatcttcaatccctgataccctttcttccacttgattgattcggctattgatacttgtgtatgcttcatgaagttcacgtgctgtgtttttcagctccatcaggtcatttatgttcttctctaaactaagtgttccagttagcagttcctgtaaccttttattaaggttcttagcttccttgcattaggttagaacatgttcctttagctcggaggagtttgttattacccaccttctgaagcctacttctgtcaatttgtcaaactcattctccattcagttttgttcccttgctggtgaggagttgtgatcctctggaggagaagaggcattctgtttttttgaattttcagcatttttgcgctgctttttccttgtcttcttggatttacctatttttgatctttgatgctgatgacctttggatgcggtttttgcatgggcatcctttttgttgatgttgatgttattgctttctgtttgttagttttccttctatagtcaggcccctcttctgtaggtctgctggagtttgctgaaggtccactacagaccctgtttgcctgggtatcaccagtagaggctgcagaatgcaaagattgctggctgctccttcctctggaggtttcatcccagaggggcacctgccagatgccagctggagctctcctgtatgaggtatctgttgacccctgctgggaggaggtgtctcccagtgaggaggcacgagggtcagggacccacttgagaaggcagtctgtcccttagcagagctcaggcactgtgctgggagatccgctgctgtcttcagagctggcaggcaggaacatttaagtctgctgaagctgtgcacacagctgccccttatcccaggtgctctgtcccagggagatgggagttttatctatcagcccctgactggggatgctgcctttctttcagacatgccctgcccagaggggaggaatctagagagccagctgacatattttttatcctcatgcctacttatgatcttgcttgattggtgatatctaattttgagaattttgaaaaaaaaaaattgaatatttcttttacacgtgcatttgccttgaaacatgataaaagtcccacttatcctcaaacagaaaccaccaatttcttttgatccaaccattatatcaagttcctgtgtccttcctattccttatcacatttcttaagaggtcagtcacacttgatgtgtctactttcttaaatcccatgcaatctccaactgattacagtttattttctcccattgaaggaaactcttttaattaggaagacaatgacctcttgcagcccaaatccaacatgttttaattatgcatcctatttaacctctggttagtatttgacactatgccacacctgtgtgtcaagaagatttgttttttttaaaagagttcagcattgtacacaaatgtttttaaagctctatataaggaaatattgctagaaccggaagtcgtacaactcctccttcttgagaactgctccaatgtgttatactctacacatcaattaatgccctttgtatggtactgtgtcatttctcacttctttctttttctcaactctcaaatacaggaggatgccaaatcccatagcttcgacctgagaaatagttcttagctattcttcttcttcccagaagtgattgtgatgggaagccctcatttttctctcaattagaaaatataatagtccctaatcgattttcctgttactagtgtcccatactctagtcatatctcacactgtaaaccaaagccaatgatatggatatctctcccatgaagttctctatcatttctctattgtttccaagatgaagctccagcaccctatttcaggatctcacagggtggtccctggatcaggagaatcaacatttcctgagaacttgttagcataacaaaacctttgatcccatctcagagctattgaagcccaaacactttagtccaggtgattctgattcacaataaagttggagaaccactgccccagctggctagtagaggaaactgtttgttcaggctgctaccagacttcgctgcctctcctgcatttgtatttctcttgcactttatgttattttcttattgactatctcatctggtaaatgccagacattaggaccaaccttccagactggaataccacacctgaatttttttttcctggcaaattgctattattacttcactatccatttcaaatgctgtgagaattccagcctccttcaagatccattcttgctccatccgtcctccattggtattttgctcacatctctgtaacagcatttaccatgtcatatcttaatttatctttctaaagatcatattttcctcctaaaactgtgaattcctcacatatagactagatcttgttcaacatcgttcccctagtggcctagcttgctgttttctgtttttctcttcttttttttgccacctctttacacaaaagatttgagagtaggaaaatatttttgaagtgaaatatttcaactcaacaccataatggtaatcaagaagcttggcaactattacaactgtgtaggggcctttttgcatatcaaagcaaccagtctcctattttcttttgtctatctgtgtacataaaatgacagtaattaattgagacagactgattcctctcacacacttcccatatgttctttctagtctactttatccatgtgtcccgataggcctcttttatacaacttcctttgtgacccccagattctgacaacaaggatctaatgtttcccaggtgatttctctctattgttcaaaaatcctattgccttaggtgcagttctttcaattccctctcctgattttttaaaaatctgattgccatttgtgatgaaggaacactgtgtggtgaagagatgaaggaacctcagggtttgggctctgtttgatggcctctttcattaaaatgcagccctctccccttgctcatatttaattcaataagatggatgtaaaacaggcaattttactccaggtgtgaaaatacattagtttcgaaaaaacaggagctgatatttcagatcagtttggggtagctttgctattactatggacttgttacaggtgtcttcatgtttccatagcttgatgttaaactgcttagtaaataactataccaaagcaccaaattaaattcattagcttaaaagcttaatgcagtttcaactggtaattgtacatttacagagaaaatcatatgccttgttttagagaaatgaaattagagttaagccaaaatagattattttaattaccaactaaacaggttagaacactttttgaataaaatctagcaaaacaaaatcagtcaataatttttaaatgatctcttaatttcatcagagtattacatattccttgatgacttccatagatttattttatgatatgcagaaaactacatctgcagaaccagaagcagagtgacttcttaatgtgattttcattgtcattgatgggacagatttttgacaaatctcattgttagctctgaacagttagagcagtttattttccagcagcaagtaattccaacttgatacaatggttaacatgaacatctagttcatgagctaaatctaaacccttaactgttaaatttacttcacgtaaggaaaacttagggtcgacctgcagcaatttcttacggtaaagaaagggaactattgcaatactttgaactccaggtaagtgagagacataaaattgatgtctctctgatgttccacttcaagataataatagatctattcttaaagaatcgtgtaaagcttaactttttgagccatagtatctgtgaaaaggatacatttggagaccagttgttcgaggtgctgatgtgctgcccatatgtctcaatctgctgtaatgggcaactgaggccatataaatacaacactttttttcccctgcaggctctgtgtaatcctttctgtgtcaaaggcagacaggacatcatcctaaaactggtctctgcacttgaactttttagcctctgccaatggccagagttgttaattagctatcataaattgccttctctgagcatttccaaatgtttgcccctagttttgcctattatgattgtgtatctattaggaatattccaaggcaggagaataatcagtctttctgtaccttaaaatatagatgtagggattaggcagactgcgggaagggaagagtagcactttgccttctaccaggagaagccctgaggagaatttatccttgtatcacgattatcttttccagcattgaaaagaggtattcaaattcagtgataactaaatcaacatcaggctcctactacggttttttccttcttactagtcttctgagaggggtgctctccctaagcaccctggagagtgctgtctgcacccttagagaaaggcaacgatgcttggagagtgtgttttgccatgtgctgcgaggtgtgtgtgtgaaaattctaattgacagcttttgtattttcatcaaccatactgcatcccttgtaatttagcccagaaaactaggtggaggataagaagcctaattgtgatcttgcatggggcatctgaatgtccaggatattgttagttgccctgaagaatgctggagaatgttcaggtcccctctgaaggaacttaataacctcaatctctccatgagggagacttattggcaagtgttccctgatgagaaacctggagttaaaattaagaaacctggctgcaattaaaaattataaatttttaattgaaattaagtgaaagtgaccagaaaaaagaaccagatattgtttatgtgtgcgtgcgtgtgtgtgtgtgtgcgtgtgtgtgtgagtgtgcgtgtgttttaggaaggaagttacttaaagaagtatttctttctgtcctgcagagctaaagatttttggttgcttctgattgacttggatggattcttaatgctatttcaggctggtgatgctggtggctaaaattgatgaagaagtgtttgtttaacacctacagccaattgtggcttttatttattcattcacgtatttattaatcatcacctgtgttccacacactcaggctggcacctggatactctttcaagaaaagctaagcattatttttgtaattattgtgtaatgagctaggcagctcactttacttctctgggctacatgtcaagaaaacaattgttaaaataagttcctctaatcaagccaacacagctggcttttgtggctgtgggagcattgccagaatatcagagaaaagttgttacaggttgagaatccctaatccaaagatctgaaatctgaaatgtttcaaaatggaaactttttgagtgccaacaaaattatttaaaatattgtataaaactaccttcagtctatgtgtatatggtgtatatgaaacataaatgaattttatgtttagaattgggtctcctccccaagaaatctcacgatgtatatgaaagtattccaaaatccaaaaaaatctgaaatccgaaacacttctggctgtaagtgcttcagataagggatattcaacctgtacaaaaaatgagggttcacattacttggtgataagttgataaaacttaatgaaacacggattgccagacagaaatccttcatctagagcaagatgttaattaccatggttgaagatcaattctttctaatttatttaacaaactactttgactgaatattagaatacaaattatagaggaaaaccaagatatctccttcagtaatttcattgtaacagaattggtacttattcatccattattccacaaatgtatttgaatgaccaattaatagtgctagaagcttgcagtataggagaggaagatgtaagtgcactgcaatatctaaattctgaaaaaaagaagctttaaagctacagtgccagggaggcagggagcagggtgcaaaaaaagtcgtaataaaagccaaagaataactcactagcagtaagataatagtctcagcatcctcttaaacactatgtctccttcctttcttttttcccagacagaaagaaaagagacaggtttatagctgttaccttaaacctgtatttttttttcttcttcctttttaactaagtggctttacttgactaaactcttagataggtagaaggagaggcctctaggctccagaaagaagaatcaaagtaaacagctttgggaaaaagagctcctggggaaacctaaaacaacataaggggtaaatggagttttctggatttaagtctgtaaaactacatttcacagcattttgctaaagcttaattctgagtgatgatgcacccaaataatttgctcaaatgtttattcatctcgttttaatcctggttcctgatagtttaaagagattattaagcaaagtatatgggaggcgatttcattgtttagaccgagctcctacactgggctccagcagacagtgaagtcactcatgctaggtgtcatgcacaattacactaaactttgaaacaggcaaggtttccagaaatgagaagattcacagcaactaagcagaaggggctcattttacctgagccagcatgatagggaagccccttctgtgttaaccctataagtaaagtaactttgaaatgaccaatctgcttttgttccttgtttctgctttcttcagcccttttctgcctataaagccaaactataaaccagagcacgccttctgttttatagaatgagatattgcccagttctagaatcactaataacagctaattacatcttaaaaccaaacttgttgtaattttattttttaacaatatcagtaaaggtgcctttattctaagagctatatgaggtggtttgatcatattattcacagaattataaagttagcataagaaaattatgaaattaaaccccaaattgtttgttgaatatggtgactggttattaatcttgaagataggaaataagatgttccttgattagtgttggtcctgaaagaacttattgtcttattaagaagaaaagactcaagaaaagtaatccaaaacagaatatagtcaagtttcaactgtatgtattatagatgttcagagaattgtgttgtgttgatttttgttagcatagaaggcattgtaaaatgtgtgtgactaggagccaattagaactgagtgtgtgtgtgtgtgtgtgtgtgtgtgtgtgtttgagacagtctcgctctgtcgcccaggctggagtgcaatggcgcgatcttgactcactgcaacctccgcctcctggttcaagtgattcttctgcctcagcctcccgagtagctgggactacaggtgcccaccaccacgcccaggtaatttttgtattttcagtagagatggggtttcaccaggttggccaggctggtctcaaactcctgatctcacgtgatccacctgcctcggcctcccaaagagtgtttttacaggctccattccttattcctggagtcatcttagggaaattttctgacattttattgccttagaactctcatctgtaaagtagagagaaagatgcctcacttgcttgctgaggactaatgagatacaattttgagaattcatttttttcatcccaatgattttcaccaaccatgatcatgctaaatttgtctcactcaaaaccaggcataatgtaatgctgttaagaacatattattctaatattcggtccagaattcctctctgtgaaccgtttctgtttagaatctgtgttcataaatgctgggagtgtgtcagctggtgacttcagaggaaaggggaaccactacacatgaggtaaaaggaggaatgtgttgttttgctactgagaaggactggggaggggagtggaataaaaggtgggagcagagaagagacaggccagcaaaatcaaaaagcaggtgctgcagagaaagagccaggagagaaacttctggtggtgagtgataaaaatggacttgggggacaggacaatataataagtgatgagcttttgccccccgtctctccagtcatcaggaaagtctattgtgcttataaatgctttgtttcaattttcagcaaacacagtaaaggagctgttttatatctggtagcacctcatgttgaccccaatataaacgagaaacaagagcccaagaagcagaggaagttaggagatagtaagctgtccagaaattagccaacgactgtggaatggctctagacttctgtagcaaatggaaatatgaggttagttccaggtttatgtaaatcaccaagggttagatgaactcccatatggcatattacaccaatttgtaaggacatcagaaaatagttcatattgtttcaaagttggctccataagcgggcaattgtttttaatatatatcagggcttagaacatgatatcccaaaatatggcaccttggcataagcagaaagctcactctctgactttctccaaccttctctcccaggccataaaaatcattctctctccctccatgtggagaatgaagactttttgggacaccttaaatccagagaaaaggaaagaagatacatacagccagagcagaatctgaacaaacaggccttgcttagttccccccagtttattgatcatatcctttttgatcaatcaggcttcttctttcttgctttctttttttttttttgaggcggagtctcactctgttgcccaggctggagtgtgcagcggcatgacctcggctcacctcaagctccgcctcctgggttcaagcaattctcctgcctcagcctcccgagtagctgggattacaggtgcccgccagcacgcccagctaatttttgtatttttggtagagacgaggtttgaccatgttggccaggctggacaatcagacttctatgtgactgtccattctttagcaaacctaggcataaaaatacacagcttttcctaagtcttcaggtcatttctgaagtttcccgtgtcacacaaaattttggttaaaaaattttgttatgcctttctcgttaatctgtcttttgttataggtgtcattcaccaattgtcaacttcgcaattggtatgaaaaagatactactttttctctcctgcacatctaatgaaattctttagttgaaatccttaggtgtaaaccaataatatccccaatctttgttttgtactaacagtcttgactttttctaaatcaaatacatccctgtggattattactctcacctgcatggtcttcagaaaagaaaaataaaattactctactggagatcacaatgacacaatattctgtaagtggagctgccttataaaactatttttgttccattctttcacagctatttttaaagttctgtttttagaattcacagttctgctctttgggacttcaactacaaagtgaagtattgccggttttttttgttttttttttttttttttgagacggaatcttgctctgtcacccaggctggagtgcagtggcatgatctcggcttactgcaagctccacctcccgggttcacaccattctcctgcctcagcctcccgagtagctgggactacaggcgcctgccaccatgcccagctaattttttatatttttagtagagacgaggtttcaccatgttagccaggatggtctcgatctcctgacctcatgatttgcctgcctcggcctcccaatgccattcttaacatttaatttaaacttgcggccaggagttcaagaccatcctgggcaacatagtgagatcctatctctacaatttttttttaattagctgtgcatggtgacatgtgcctgtagtcccagctacttgtgaggctgaggtgaaaggattgcttgagcccagacgttcaaagctgcagtgagctatggtcacaccactgcactccagcctaggcaagagagcaagacccggttgcaaaaaaaaaaattcttcctgcattcaatgacatcgcctttcattttggccatttcctcccctccccagttgtgacctccatactgggttatgctccaggtccctgattccttttcagaaagtctctgtaattggaattggaggtgtgagaggagttcacagtcacacaaagcctgctgaagtatggtaagccttactcacacaggcaacttttaactgtgatgacatctcagtaaaatgttatacaactacggtgtcatttaaatattctgtgacattttcagaggaaactttccagtacataaaatcatctcgtgttacctgagagaatgacaactctgtttttaaaattactctgaaattcctagaaaatcaaaccaaaccgaaaacctcactatgttttttattttactggtaaataaatattttttcttggtcatatttaggttatggtgagagttaagtaatatgtctgagagtacattatttaccataaatctttgtacagacactcctattttattagctattttcaaaatatcagaaactaataattccccttcatttctacagggcaatagtgatcctagaccaaattccttcctttttctctccaaattggttatgatactgcttcctcaggttggtccactatatttaggcgtgaaggacaaggagagacaagctgtcactggtcaaacaaaacaaaacaaaacaaaacaaaaaaaaacacagatacaagggcttttcaggttagtcctagagaatttcacaacattccagggttttcactgcttctgtgagtaaattttctttcctgctcccatgcaggaaatggttcagcatcgtcaagccattcaggccttcgttactgccatgttttgaatgtgcccccccctcaatttcatgagtgggaaaccaaatttcctatgtggcagtattgagaggtggaacgtttaagaagtgagtggttcatgagtgctctgccccctgagtggattaatctactcatgagttaataaattgatgggttaatggattaatgggcaatcatgggagtggaactggtggctttctaagaggaagagaggcctgagctagcacgttagcatgctcagccccctcaccatgtgatggtctgcactgcctcaggtctctgcacagtcctcaccaggaagaaggctctcaccagacactgagccatgcccttggacttccaagccacctgaattgtaagaaatttcttttctttataagttacccagtttcaggtgttctattataagcaacagaaaacagactaagacagctatgttatgaagactcatttttgaaaaaacatagacatgatccttaaaataaatacatatgtgtgtaggtgtatgtgagttacacaattctaagattgcttgtcttcaaattatacaacaaaataattaacatgaaaaagaagcacagtataatgttattatttttcagaaaaagctgttagactaggatggagaaagtgatgtcatgtagtcaagggaagtctttgatttaaagggggatctatttacttattgcacatatataaacagctttaaagaatattaaacctactaagctacttatggttttgctctgacaactacttcctttggtttttggtttcagttggcttctctgagtcatcttgcttctctgaacaagtgaggtatttgctgtcagtgatgtgggctgaatcaatacagtgtcactgtttatgctttaaattgatgagttttcagaaggtggcagtggtatgagagccagtgattcagctcaccctaggattgttaacagaggttaatatagtagataaacggtgtgttctatttttctttcaaaataatgatatgttaaaaatattatgaacatggaaaaagctttcaataaaatccagcatcccttcatgaagaaaaccctcaacaaactagtcatcgaaggaatatacctcaaaataataagagcaatctatgacaaatccatagccaacatcatactgaacaggcaaaaactggaagcattcccttcaaactggaacaagacaaggatgttcactgtcaccattcctattcagcatagtactggaagtcctagtcagaacaatcaagcaagagaaagaaacaaaggacatccaaataggaaaataagtcaaactatatgacttcatggatatgattctatacctagaaaaccctaaagacttcaccaagaggctcctggaactgataaatgacttcagtaaaatttcaggatacaaaataactgtacaaaaattagtagcatttctaaaaaccaataacattcaagctgagcgccaaatcaagaacgcaattccatttacaatagccagccatatacaaaaattatgtaggaatgtgtctaaccaaggaggtggaacatctctacaaggagaaccacgaaactttgctaaaagaaattacggatgacacaaacaaatggaaaaacattccattccatgctcatggatacaagagtcaatgttgttgaagtgaccatactgcccaaattatggtcatcaatctatagattctgtgcaattcccaccaatatcatttttcacagaattagaaaaaaacaatccttaaattcttatggaaccaaaatggagcccaaatagccaaggcaatcctaagcaagaagaataaaactggaggtatcacattacccaacttcaagctatactacagagctgcagtaaccaaaacagcatggttctggtaaaaaaacagacacatacaccaatggaacagaatagggaagccagcaataaagtcacacagctgcagccatctgatcttcaacaaattggacaaaaatcagcaatggggaaatgactccccacccaataagtggtgctaggaaagctggctagccataggcagaagaatgaaaccggacccctagctttcactatatataaaaattaacttggctgggtgcagtggctcatgcttgtaatcccaacactttgggaggctgaggagggtggatcacctgaggtcaagagtttgagaccaacctggccaacaaggtgaaaccctgactctactgaaaatacagaaattagctgggcatggtgacaggtgcctgtaatcccatctactcgggaggctgaggcaggagaatcacttgaacctgggaggcggaggttgcagtgagccgagatggtgccactgcactccagcctgggcaacagagtgagcctctgtctcaaaaaaaaaaaaaaaaaaaaaaaaaaaattaactcatgacagataaaagatttaaatgtaagacctcaaactatgataatccaagaagaaaacatagggcgttctagacatttaccttgggaaagaatttatgactaagtcctcaaaatcaatggcaacaaaaacaaattggcatgtgggacctaattaaactaaaaagcttctgcacatcaaaagaaactatcaacagagtaagcagactacttacagaatgggagaaaatattcacaaatgatgcatccaacaaaagtccaatatccagcatccagaggaaacttaaacaactgaacaagcaaaaaacaaccccatcaaaaaatgggcgaaagtcatggacagacacttctcaaaagaagatacaagaggccaactgatatatgaaaaaatgctccatatcattaatcatcaggaaatgcaaatcaaaaccgcaataagataccatctcacaccagtcagaataactattattaaaaattcaaaaaaacaacagatgctggtgagcgtgtggaaaaaaggaacacatactctgttggtgggaaaataaactagtttagctactgtggaaagcagtctggagatgtttcaaataacttaaaacagagttaccatttgacccagaaatccccttactggatatatatccaaaagaaaacaaattattctaccaaaaaggcacatcatgcgctcacctgttcattgcagcactattcacaataagaaagatatggaatcaacctaggtgtccatcaacattggactgaataaagaaaatgcagtacatgtacaccatgcaatactacacagctatgaaaaataatgaaatcatgtcctttgcagcaacatagatgcaactggaggccattatcttaagcaaattaagcaggaacagagaaccaaataccacggcctcactcgtaagtgggagctaaacgttgggtactcgtggatgtaaagatgggaacaatagaaactggagactactggagggagcagagagggagatacataagcattgaaaaattattgggtactatactcagtatttgggtgacgggatcattcataccccaaacctaagcatcttagaatataactaggtaacaaacttgtatatatacccctgaatctaaaataaaagttgaaaaaaatacgaattagacttatattcataattgataagtaaccaccgtgctttaagcttccatacagaattttctttgctggtaatagtttcttatatatgctaattaagttggtaaaactctgctattcttccatagaatatttgcctaatctgtgtttctttctcttaaaatatcaaataaacttaattttcatgggtttgctaaatatttttgctctgtctttaagagttaggtcaaccgagttgttggtgttgaaattctccagcattcaaactatggttggtcattatggagactgaaactgtttagtctcatatgcctctggtagcaatagtttctctcccatctctattttgcatgttctgattttgcttgtagactataaaatgcaatctagcataaggactgcctttattgctttttaatcctagcatctaacatagcatgttttgcagatgctcctcaatttacaatgagactgtcacaataaacccatcataagttggaaatactataagtcagaatacatttaatgtagctaacctactagacatcatagcttagcctagcctaccttaaacatgctcagaacatttacattagcctacagttgggcaaaatcatctaacacaaagcctgttttacaataaagtgttgaatatctcacgtaatttattgactatattacactgtgtagtatagtactggtttaccctcattatcacctggctgactcagggctatggctcactgccattgctcagcatctagagagtgtcatactgcatatcactagcctgggaaaagatcaaaagtcaaaatttcaactctggtttctactgaatgtgtatcgcttttgcaccactgtaaagtcaaaaaatcataagttgaaccatcctgtctgggactgtctgtatacatctttgagctccacaaatatatgatattaataatggtacaatattgtaagtaatattttaaattttagaagagtagtacttactagaggagtatttcctgtgtaactgagcactgtgataaatccacctaatactttagctcacttgttcctcataacaatcctattttacagatgaggaaatgcacttagactaggaaacttgcccaaggcttaggataaatatatttcatcttaaaagataggtgtgattcgagctgtcactggcattatcagactttttatatcagattttattgatgatagatgacataaattgggttcttaatatgttaagcattgttctgttaattaacttatcttcacagcaacataaagagggaggtagattattacttgtattttggagatgaaaaatgccgacattgaggggtttagtagccaggcctcagaggtcctgtagctagctgctaaaataccttgccaggatttaaatcatggaagtctcttcaatggtatggctctctgctgatttgttatacagccgtttatttaaaattaggttttaacccagcacatgatatgaagattatttaagatttcatttcccattttgaataattttctgtgttttactagccaaagacatttaatgttagttttcattttgataaaattatctcatcaatatttttacattactgtcatcaaaaggctgttgttgagattaatcatgcaatgtgtttaactagaagatgaaataaaagtcacatgttacacacaaacacactcaactgatttttaacaaaggtacagaaacaattccagggaggaaggattttcttttcaacaaatggtgctggagcaattggacattctaaaaaatgcaccttgactaaaacctcatactttattgaaaaattaacttaaaatagatcataggcttaatgataaaatataagaatataaaacatttagaaaaaaatcaaatagagaatatcttcaggacttagagctaggcaaagagttcttattgattacacccaaaacatgatatgtagaaaaagtttttttataaattggaccttgtattagtccattttcacactgctaataaaggcatacctgagactgggcaatttacaaaagaaagagaggtttaatggacttacagttccacgtggctggggaggcctcacaatcatggtggaaggcaaggaggagcaagtcacatcttacatggatggcaacaggcaaagaaaaagcttgtgtaggtgaacacctcctcatagaaccatcagagatctcatgagacttactcactctcatgagaacagcatgggaaagactcaccctcatgattcaattatctcccaccaggcccctcacacaacacatgggaattcaagatgagatttgggtggagacacagccaaaccatatcagacctcatcaaaataaagtgtttgctctgtgaaaaaccctgttaagagaatgaaaaggcaagctacacagtgagagacaatatttttaaagaccatataggacaaagggattgtatatagaatatataaagaattcttgaaagtcaacagttttaaaaatacaaaatgatcaaaagacagacacgtttccaaagaggagtggatggcaaataagcacaggaaaagtgttcagagtcatttgtcatcaggaaaatgcacattcacactacagtgagataccactgtaaacctatcaggatggctaacattaaaaatagtgggccgggcatggtggctcttgcctgcaatcctggcactttgggaggccaaggcaggtggatcatcaggtcaggagttcaagaccagcctggccagcatggtgaaaccctgtctctactaaaaatgcaaaaattagctcagtgcagtggcacatgccagtagtcccagctacttgggaggctgaggcagaagaattgcttgaatccgggagacagaggttgcagtgagccgagatcacatgcaacggcaatccagcctgggcaacagagcaaaactccgtctcaaaaaaaaaaaaaaaaaattagtgataacaccaaatgctgatgagaatgccgagaaactgaatatcttttactttgtgtgaatcaaaaatgacagaaccactcgggaagtaacttggcagtttttaaatagaaatatatgtaccatttttgtaacttcatattaatctataattatttcaaacaaaaagttaaattacctgtcaaagtaagatgagaatgagttgttattgtattcatcattttgttgcaatgtttaaaataacatcattgataatgtactcatagtagatatgtgtggctattttttaaaagtttttgtctcaagttgcttcatattaaaatgtctgaaacattctagcatttcaagaataaaaatttcctttaaaatgttagtcatgacctggcaaaattttttttttaattctgaacaaccactgggtggcagtaaaggcttgggtttttgttcatttgcctggtgttttgttttttttttttttttttttttttggaaagttgagaaaataaggaactaatttggttctgctcttagcaaataaaaaaatctgtagtgatagatattattgctgattggcaaggtttaagctgcaaatccaatcattaagaaataatatttgtataagttaaagcaataaataacacacactctaagggatcatatgcagagtaaaaccttataaaaataaaccttgggctaacagtctgagacgagatggacaattctagaaaaaaaaggagtttggcattgcgtgttgtaatggcatgtgggattttctggttcaaaattttactggctttcagaaattctaaacaacccctttatttttctgtttcctctcactaataattaattacacaaaattcaactagtcttcatttcttatttggaaaatagttttcctcttttaaatgtatattaaaatgtcagaatatgaggagaatgatagattctcctctataggagacagaatatatcacattttgaaatgtgatgagtagatacattttgaaatgtgatatcacatttcaaaatattaatgtctttttatcttgacaaaactgagagaaaacctctatacaacctgttgcatttttcataaagtttacttgccaggagcaaattgagacattgactttaatagcaagtttgatgagatcctatgcttttcttcacagcttaacctcattaatgcatctcattctaaatatatattatcatcaaggatgaggcatttatttgcatatgttactgttcttttgtgtcatcctaatgtcatataaaataaaacaatggatattaggtctggcactacccaggtagaagagtcacattcaaaacttctgctgaatattcataatagtattgtcaaaccagatttccatgtgaatcaggcatcaaaacaatttacaaccaaaaggtccagtatttagtctgtcttctcaaccttatggctgcaggacagtgaggatggagcagaatgtctgtaatgagacaactacagtgaggttgggataataattcatcatatcattgtgtgatttgagtgtgatgatgccgtgaaaatgcttagcactgttcctgggtgacaagagcaaaactctgtctcaaaaaaaaagaaaaaaaaaagaaagaaaaaaacaaaagctatgccctgatcaccttgggtatatgtcatcaggacgtcctgaggctgcgttatgggcatgaatcctcaaccttggaaaaataaactttctaaattaactgagacctgtctcagatatttggggttcacatttgggtgaccacaaagggattctgcatggagatgcccctgacctttgacaaatctcctattggtgtttggtaccagcttgagctatctttatggctcaaaccaacagaacaatttgctgaggcctggaagaacccctccagagaatccctgatctcctaaaatttggtcaagatctaaagtttagtttgctatacaactgttttggagttttacttgcttccaacccaagaaaggcaagttttttctgcttccatgatgatggaaggcaggtaactcctttatggagtttgaactcacttccaacaggtaagatgaatttgaaatttatcctgtttctaggatagtagagagcagtctttagcatgagacatattcctaggtaagtaactgaattgggaattttcttggccaaagtgaagattaacaaccagctggtcttaatttctccttaccattagagcgctcagtaatcatgtaagttgtgccgtcatttgttttgcttaacagtttttttgttgttgttgggtcttttccccgttgggtttgattaactctatctgacttgatcaaatctgaaggaaagttccaaactatccaaaagcaaattacaaattataacaaactatccaaaagcaaattataaattgtctttttctgacctaattaatactttaagatattaagttccctaaagtccaaaaatgacataatttggcttatttgctataaatattatataggaagcattgttaaatatgaaatggtgtttggttttctttgggctgtattggtataaatatgttattggtatatgttacaaaattttgggaaactcctataattctgatattacttagtgtacattatcagtaataataattgctatgttaaattattctgtgccacaaaggtaacaaatttccttgtcaattgtgtgttttgactaaggctgccctaaactttttgtcatctatggacaattgttgtcttgtttttgtcctctttagaagatggctgtataatcagctataaaacctgacaggtactcttgaatgcaggtttctgataactttggagactgatatcagaatagagaaaaaactttcaggactcatggagagccaaaatgttcataaatatcaagcagaacaggaattaactgcatggactgactaaagtaatcgtttttacttttttcttaaaatgttactggttctttgttttatttctcaaagaaacatttcttttgagctattggcagcttttaacaattaagtatactcctatgaacaaaatttggagcatatttgtttgtctccacctgatttctccagaatttggaaactattcatgagtattcttaatatatgtcaatatagttatttgcatgagtgcaagaagaatctgttttcatttgtaacaggatacaattagagaaactggttattttaccaaggccttgactggaatggagtgctttcctttaaggaaaaaacttcacttatacagccaataaaagccccttgggaaaactggcctcatattttgtctacgccatccctgtacagaattcttgacctgtggtaagtaaagaatgtcactttctgacagacccagcagccctgagttatcttgggacctcaagaggagaaggattcacccaattcatagatatttgatggtacacatccatagctggacttagctttaaaaaaatcttatctgagattccttctatagaacaaacttccatcaaagccatttatttatttacttacttatttatttatttattttttgagatggagtttcacccttgtcacccaggctggaatgcaatgaagcaatcttggctcactgcaacctccgcctcctggattcaagcaattctcctgcctcagcctcccaagtagctggaactacaggtgcccaccaccacgcccagctaatttttgtatttttagtagagacagggtttcaccatattggccaggctggtcttaaactcctgatctcagatgatctgcccacctcagcctcccaaagtgctgggattacaagcgtgagccactgtgcccctcccatcaaagttaatttaaatgcctatatgaaaaataattattcttgctgtactttatacaaataatctggccaggcataatgaagcaaatggtttctaccatgatttgtctttagtaaacctgggaaactgcagagagaaaaattaggtttcaaaaactatagtacacctgttgttagattctagtcttgcctaatgtttttcaatttttactattttctacaatttggactgaattctaatttttcctgacttcaagtctccaaagcaatgttttcaatttttcttctttttcttttcccctgcatttttgctgattagtagtcaccaagaatgtagttatgctttcttaaagccccacgaactgaatctagacaacttaatcttcagaagaaaataacagcaatctatttacctacataagccactttcctacctccctactaatgtatggacttccaaggagtgtggactatatggattctccaggattctttgtttgttgttatttttctcttttcctctccctattttctcttcataggacatgcaacttctcaaccttctaaaaatggggtttcctaacagcttggggcctacctatctaggaataaaccattctagccatgagagatcagacaaaacctgacaccagagactcattttcttttaaaatgctttccctaaaacatttttaaaaggaaaggagggggaaaatgtgagaggaaaagaaatcttggggcgccaaaagtcactaagctaaagggaaaagtcaagctgggaactgcttaggataattctgtttctctcctcactgagataaaatacatatgtgattgcctcctttgtaaaggctaatcagaaactcaaaagaatgcaacagtttgtctcttacctacctgtgacttggaagccccctttctgctagagttgtcccgcctttccagacggaaccagtgtatgtcttacatatattgcttgatgtctcacatctccctaaaatgtgtaaaatcaagatgtgccccaaccaccttgggcacatgtcatcagaacctgctgaggctgtgtcatggtcacacaccctcaatcttggcaaaataagctttctaaattaactgagacctgtctcagatattcagcttcacatattcatctcatcttggccccctcagcaaagtggcaagaggtagacaatccgtttttattaatgacaacattaaagcagagaatatactgtaggagactgtctccaatactttccagaagtgttgtgccacaccaaaatcagtggcatttacttttgtgagcagataatttatctgtgctaccgacttcacaactgagtggaattaaagtaaggtagcagaaaaaaaaatactaaatcattttaattacgagttcatggttaccaatgtgctaggcactataaaatgattttgtcagcaaacctttgcaaccctatgatgcaaatttgtttttacacatgaggaaactgggttcagcaaggtgagatgacttaggtcacacagcttggagcaagtggaacaagattttaagccctgatatgtttgcctcaaggcttagctgtttccactgtgaatactgctctttaaattagggcgtgaactcaactgaaaatctcattctaacccagagatatgaacccactaataatcatccccaaagccattccttatttgctgttttctagggtgtggaaaccttggcatttcaggatccagtctctgtttgggaagcaatatagtcttagagttaggcgtatctgctagatataaaatgcaaaagccatgtagcttatttatgtctcaatttctttattgctacattattaaatttgtatactaatatttactaggttgcagaagggatcaaatgggaaaatttatctaaagtacttaccatagtacttgtcacgaagtaacttattgtctcttatgtagtgcatggtttttgaggcatatgttgctaaattactcattattggccagcacctgggtccaagttatctggggctttgccattcggagtgtgatcagaggaacagcagcactggcctcatctaggagctggttagatcacagaatatcaatcacagtttctgacctacgcctattgaacagagacctgcaatgtaacaagatcctccaaagatttttttatgtacatgagattttgagaagcacttaaacatagggtattttctcattcttattggcctctataataggtaagtcagcttacttcctccctttctatccatcgtattatccctctatgtctcaatacacgtacacatacatacaggcacatacatatatctatatatgtgtttgtatgtgaatttatatgtatattcattatatgtatgctttgtgtcaggcagtatgatgaaaacttaggtttgttagtgaacaagaaagtctttgctctcctagaatttgaaatcactggaggacaagcaccatgatcaaaaggggaatctctctgagggccgaaggttgaaccaggaataggtagcagggggattcgcaagaaagaaggtagacatcccacctgaaattcatgaattggtctttccatgtagccagtggtaaggtctgatgagcagtctcagcctcatgacgttaaaaatgtatttccatgggcttggggaatcctgtgaatccacaggttgtcagttgaatcagctcataaaataattcttgaggcatcttggtctagattaaattcactttggtgtgagctcaagggagcctctaattgttccactggaggattcagtttatagcctctcctcctaaactatactaggtgaatggaattaagaattcttaaagtgaagcttgttagttaaagcttatttattaccatgctttgtaatcatacagattactattatcatcatataatatattacaactatatggtaatatcgataattattcattaggtactagtagattattattcaattgatagtcaataatatgttataatcatgtaattataatttacaatatattattcatgcatcataatcagaagatttgtgaatggttttgattttctatttcaagatataataaagtttaaagcttgagctttcctcacagatgtgattcctgggttgattgtttctgtattttgtagcccgatctctcatctgagaagttatttaccaagaggtcagtacataaatgagttccataaagtcctccaaactgaacagcactttgtctcatattgcattgatacatagagttttggcatttttaaaacctctgatatcagagaaataaggaagccaatttgctaacctaagaaaagtaaccttttttggtgggctgaggaagttaaggaagctgtctttggctcttcctgggtgtattgactgatttacatgcttgcatttacttttaaattgtgtggatattgaagtcttctctctctttacagctatgttttattcacagcaaagcataaggaccattttatggtcccaatacacccctcaaaaaaaaaaattttgaggggtgtattgattggtgagcatttgctttccagtatacaggaatcctatctggacaccataccaccacatgggagaagttctttcataagcttatgagataggtactgtcattattactatttttctaagggcggaaactaaagctcaatagtatttatcacttgagcttgtgaagaaatgttttacccaaaagaggctgcataggccaaacacttaaatacatccaataaatattcacctagattaattaattgatctttacccagtctgaaggtggtgataggatagcccagttttctttgggactattttatctcaccacatttttttttcagctacacatattcttagctatgttttgtctgaattagtatggaattaaaattttttttcatttttttacagcagctttattgtgatattacttccataccacacaattcactcatttaaagtatgaacttcaagatttttaaatgtatcattccatttattttattttattaattaatttttaaattgtataactgacacataataattgcacatgttcatggggtacaatgtgatgttttaatatataatgaccaaatcagggtaatgaccttatctatcacttaagacattgatcagttccttgtggtgataatatttagaatcttctcttctagctatcttgaagtatgtactaccttgttatttgctatggtcactctattgtgtgatagaacaccaggacttattcttctggtctcactgtagctggcattatcaatttttaaggaatcctcttctaatttaatttagtccctggatatggaatatggtttatttttgtttttattttgatataatttattttgtctttttatcactttactaaaagattacccgcttgctagctatgtaaacctgggtgggttacttactagctctgggtctcaattttctcatgtaaaaatggggtaaataacaataatacatacatcatagggttgttataataaataatcaggtaattttttaaaagttactataacagtgcttggcacataataagagctatgtgtttgccaagaaaaaattaaagagagataatatgtccagaaaattagcttaattattttctagatagtttctaattaactttctttaattgtgagaaattgaaatagcgaggcacagtggctcacacctataatcccggcactttgggaggccgaggtgggcagatagcttcagaccagaagtttgagactagcctggacaacatggtgaacctaccccccctcaccacatctctaccaaataatacaaaagttagccaggtgtgatcaaacctgtagtgccagctacttaggaggctaaggtgagaggattactcgagtgccagaggttgaggctgcagtgaactgagattgcaccactgctctccagcctgggcaacagagtgagatcctgtcaaaaaaaaaaaaaagagagaaattgaaaaattgaaatacaaaatgctggcccctcagtagaaaaatcaacattttgtttttagaactattttcaaggggttattgggagggtgccatagggccatagcccttcccttctaggctgtaattctccaacacgggtgtcagttattgagtggctggcagcataacagggaatcttccagaaagttggtgactgataaatattgtctgaattaatgaggatttaactcattctttctcagtaattctcctgcaattctcagcttggtcaaacaccccctcttccagacgtcccttgttagtccagatccttgtgaccacagcagtcaaccacaaagtcactgtggtgggagaattctgacataactaggagtgcctggaagaggcagaggttgatagatggtaacttccagaaaccataccaccaacttctccatcttccagttaagtaatttgaaataaatttttgaaaatgggatgacttcagtatcctgtttgtattttcataaagaagcacatcaaagtatctcatgcaaaataataatgataggataatccttggaattttaaaccattttgtccaaagagtagggtttttttttaagatttctctagagaaattcaatatttaaaaaacattgttcagcacatatgcttgttgaacaatcagcaaaataaaataatatgttgtccacattcaaagcatttttgaaagttgtagataagtattttttaaatattgccattgttttaaaaaatatttgttgatgtcctggttcttagggagatatgcacttagcatatgagtgttcatgaattttagtgtcattattgttattgctattattactggtattctcatctttaatactctgcattcctcacccttctacttcttaccattatccttttaggtccaattgcaatcttccgtggcttgctccaagcctgggtttggactcatgctgctccctacacccccaagtccagcaagggttttctgttggaatttacttccagaaaccaagtttaaatctttttcatcacttcctctaaccagtagctaaatgggatcagcaaaactaacccaacagccactctgcacacactttaacctccaatgaagttatggcagctgggtctccagcattgtgtctaagagagtcatggggggaagatgaagagaagatgggaagaacgaagtaggtagaaagttgataaagttatgaaagaaagcagagtaaaggtgggcaaatgaatatgagaagggatctgttccctactgaaacttaggtcagtggtggagaaaaatatatggaaaggtgcaagggcctagtgaagtaaacatgagcacagtctcttttctcctaagagtctttcagttttcctttcattacatatttttctttttgaaaatgacatctcagaaaattgtctttttttttttcccacgatgtccttgttaggtctctaggatatgatactaatataagaaaacctatatagtaagatgtattatgagaccaaagaaacctagtgggttatgtatttccttttgactattagctgttgtggctgcactctgtgatgaaaatagatcacattgtggaaaacacaggatcatggcaatattaaaatgttgccttttttttttttttgagataaagtcttgctcttgtcgcccaggctggagtgcagtggtgcgatctaggctcactgccacctctgcctcccagattcaagtaattctcctgtctcagcttcccgagtagctgggattacaagtgcctgccacaatgcctggctaatttttccatttttagtggagatggggtttcaccacgttggccatgctggtcctgaactcctgacctcaggtgttccgccccccttggcctcccaaagtgctgggattacaggcatgagtcaccgcgcccagcctgtttttaaaaatgttgttgatgtcctggattcttatggagataagcacttagcatatgagtgttcatggggtaaagtatatttgctcttagtgcctgtattcgcttgctagggctgccttaacaagatactacagattggatgggttaaacaatggtaaatttttgtgtcggaggtccagagtctggatgtctgagacgaaggtgtcggcaaggttggttccttctgaagattttggagaatcttccatgcctttctcctagcttctggtggtttgcccacaatctttggcttgtagaagcatcaccccatgtctgccttcatcttcatatggcattctccctgcatgtgtgtctgtgtccacatttccactttttgtaataacactgggcatattgaaagaggggcctactctcctccactgtgatttcatcttaagtaattaaatctgcaatcacactatttccaaataaggtcacattctgaggtactgggagttaggactttaacatgaattttaaggggacacaattgaatccatagcagtgccagttcaggaaaatttaacttaatttactgttcttggaaacctatcatttaggttgagggttctttcttagataggacttcttaatgaataacgtaaaaatttttaattaacaaagtaccgtttccaagctacctacatagaaattttcacatgtatctcacatggaaaaacctacctatatgaagtggaagtcgtcatccaagtaaatttgtaaagagtgaagagggcacaggtgaacacaggagtccaagttgttcctcccataggtcagtcctaaaatcaagaagtcatctttcagtgtcaatgtcaggtccaagttgcctgaagaaatcctaatggtttgtttttctttttccaagataattactgtctgggctaatggtctgtttttgatagactatttctatcttgactggataaattctttccaagtctctcttcaccccttctcctattggttaaaggaaatcctttgtgaagcttgtctccaatctctagatatggggtctggtaacagagaatctattcattcttttctgtgcactttgtctttaaggagcaggggaggctggggagaggtaattccatttctgtttcatctctagaatacatacacacaccctatgaaaacacttagtcctaaccaaatgtactccacacctatcaccctctccctacccccgacacgtgtatacacacatgcacacacacacaagctctctcttcatgtgttgtgggaaacttttaggggcagttgcacatggaatcttcttaaaactccctgagcagtttgaggctattgtattatacttgaaaatgaagagtatcttatttttaacattgaactgttaatgcacgcagggaattgggaagaaatgtgagtctgactaatagttgattagagaaaacgccatagggttaactggagtacaaacagcaagagaatcatgaagtgattttatttggagtttttgaaactttcaaatttgtgttttagattctggtaggaaaatatacaagctgtttctcctcccctacagaaacctggtatcagaaataagtcaaaattttagacatatctttttccatttactaaaattcttatggaataagtacttccaattatccaaggaggaattttgaatattatgcatgcgtgcttgcatgattgagagagaatttttgcatctattttttgtaaaaatacaaaatacatgtatttatagaagggaaagttcaaaaagtaagataaggtaaagtgtgattctttattttgagcgtattttagattttttctttcaaaatcatgaatttaaaagaaaatagtatttgtccaaatatttcaagattcctttcaataactaccatcaagacactattcttttcttatgagaccttgcccctggtttctgtggcaccatgagagtgattcaataggagcaaatgaacagttacacacaaacacacacccaggcacacttaaatgttggcattcctctttccaagtctcacatccttaaagacagagttaatgtttgtgctaaagatagtggtgttcactgaacattccattgctgtccatatttctcaacctccttgcaatcatgcaggaccttgtgattcgttttggtcaatggttgtgggtggaaatgatgtgtaatgtttgccattttaacatagcggatgtgtaatgtttgccattttaacatagcagcctactcagctaatacaaaggttttacacagcataaaccacaacacactttaattgttcaaatatccacaattttatcttcctggtgtgaaaaagatctaaaaggtatattctgatggtcatggactctcagtcttgggtcatctttctagctggggaagaggaggaggctgacacatctttctagctgggaggtctataattttttaaaagacagacaaattagagcaactggccccatcgtaagaggatgaggtggccacttgaatagaattttagggtgctaaccgatgcctttttcacttagagcacactagggctacacagaacattaattagcttaatttaaacacacttttaaacttccaattcacgtgtttaacattgaaatgtttaagcatttgaatcctgctacattttaaagattcaacactggcagctgttgcattatctcaaaagaaaatgcaccttaatatcaattcagcttgttccatttgaatatgcaactcgtgataataaaacatttaaatattcccttcaaatattaatgtttgacaattactgggcctactaaaattatcttccaagaaagaaattgctcaaagaaacagtataagaggaagaaactggccctacctcatattgctgcaggacagctcaccttcctctctgtactgtgatgtttccaagattgcagcttctatgacactcaataattaggaatataatcagtcattttcactgctgtaaatagtgcatggtagagtccccaccagcatctgaggtcccaattaaaatcaaaggaggaagagaggatctactacttgaaagtatcccactgatatatttaaaaaaaattttttttaatagttttgttccagccataccagctggaagtaatttccttttaactattaaatagaattttctcttttggcattctgtaacacttgcatttatctccagcttagttaattgtagcaaacgtttctaatatttcagaaaactccaagtgcaaatcattaatataggaacataaaagacatttaataccattaatcctttcccacaatttaaaaagattaaatttaaattaaaatttaaatataggattaaataggattaaagattagggctatctgcttcagaaccaaaggtataattctatatatcccttgggtactgcagctaaagaaatgcaaaaactttgtgttttcttcactaaaggagctattgagaggggaaacctgttagttctctgcatccaaaaggctgactacatttatgtttttatatgtacagatgttcctagtttgaaatatcaagactcatagagttgagctgacaaattttaaactgtctgcaattttggatttacaagcactacgcaaggcactagacaatagtgaagaaaactgtacgtgagttgtgtcaccatggtgcttggaatagtgatggagacagagattacacaaataatgtaaaattgtatttgtgataaggacagtaaatgaatggtatttggagccataacatcatttagccaagggatgtgatatattacttgcagaccaagcaaactttccttgagagagtgatgataggatgaaatctgaaggtttactttcagcaaatgaagtgggagaggaagagtgttccaggcaaaggcaacagtatgtgttaaggacttacgttgagatgatatgcagacattgcatttttaagctctagaagtttgatttgagttcttttccattatcttccatgtctttgcatgctcaaagcttcttgaatatatggcatgtatttatactaactgatttgatgttcttgtctactaaatctgtgttatttctaagtctgtttttattgattgatttttatccttattatgggctatatattcctgcttctttgtaactatggtaagttttaattatatgctagaaaatgtgaattttacctttttgggagttgaatatttttgtatttctatgcatattcttgaattttgtcctaggatgctgttaaattacttagaaacagtttgcttctgttttttgttcttaagatttgttaaatgggaccagagcagcatttagtagccaattttgcccttttagtaaagtagtaatgtttttagtattctatccaatgccccttgaattaagagggtttcctgtggggaaaagaaagagagatcagagtgttactgtgtctatgtagaaagaagtagacataagagactccattttgttctgtactaagaaaaattattctgccttgagatgctgttaatctgtaaccctacccccaaccctgtgcttgcagaaacatgttctgtgtcgactcaaggtttaatggatttagggctatgcaggatgtgctttgttaaacaaatgcttgaaggcagtatgcttgttaaaagtcatcaccaccccctaatctcaagtacccagggacactaggaaagccaggtattgtccaaggtttctccccatgtgataatctgaaatatggcctggtgggaagggaaagacctgaccatcccccagcccgcagtaaagggtctgtgctgaggaggattagtaaaagagaaagccctctttgcagttgagataggaggaaggcatctgtctcctgctcgtccctgggcaatggaatgtcttggtgtaaaacccgattgcatgttccatctactgagataggagaaaactgccttagggctggaggtgagacatgctggaggcaatactgctctttaaggcattgagatgtttatgtatatgcacatcaaaagtacagcactttttctttaccttgtttatgatgcagtgacatttgttcatatgttttcctgctgaccctctctccactgttaccctattgtcctgccacatccgcctgtccgagaaacgcccgataatgatcaatacatactgagggaactcagagactgtgccggcaggggtcctccgcatgctgagcacccctgggccgacttttctttctctgtactttgtctctgtgtctctttcttttctcaagtctctggttccacctgatgagagaagcccacaggtgtggaggggcaggccacccttcagtttccaatctcaccggtgggcacataagctattctcagctctgggtgaaccctaagggttgtttcccctgctgcttgggtgtttctttttccagctttggataatttgctcacatgcatatcctgatcaatatttggctgaatactcaagggggaccctctgcagatctctgggttttctttctctatagttctctcctctgcggtagtctgccatgtccaactaaataacaaacagacagggagactctataaaagaaaatagtatttattcaggagtagcattgcaatgggaatatgcataacatgtaaattatgtgcatattccaagaggttgaggcaatggggagtttttaaaggcaaatgaggaggattacctatgttttcttgtttgttgttttgtttttaaatcaatcatccttggctacaaagatcaataacaagggcaaatcagtccaaggttaaacagaaagttgctgggcagacgcccttgcagaagcatttactggacaaggttgtggtgacctttgtgcaaggttgtggtttttgcagtctgttttgatagttttgttatcaggcaaacatgcatgagagccctcccttcatggccttcctcaggtccattttgtcagggcatgacacaagtaactccattttgattctgacagctttgacagccttgtgaactcttgcttccttggcctccttgaactctcagctccatctcctcaactcagggaagtcaatggacttctcctaggttcttcatctttttctattttgtgctgctataacaaaatacaagagactgggtaatttataaagaaaaaattaattttctcacagttctggaagctgaaaaatccaagatcaaggcactagcaggtttggttgtctggcgagggttgctctctgcttccaagatagttctttgttgctgcattttctggaggggaggaaaactgtcttctcacatgtatggtagaaggtggaggggcaagtgtgaagcatcttttataagggccataatcccactctcaagggaggagctctcatgacctaattgcatgttaaaagctccaccttttaatactctcacattggccagtaagttttaacacctaaattttggagagtacacattcaaaccattgcacccaccctgcactgcagcctgcaaactctttaggcggtgagctgatccaactgcagggctcacatcgtttgctttccttgtctcaggaattgcagtcctgtgctaccagtatctacaagccattgttttatgtcttgtccatttttatggttgtttcacatggaagggtaaattaagtccctgttattccatcatggcaggaagtggaagtttgaaagactgataaaacacctgtgtggctagaattacatgttgccagatgagaccagaggagtagactggcagcaagcagattttccagtttgaaaaatattaatgtatctttttctctttgccttttcatgtacacaatgtgtagatgctagcataaggcacctgtttacttggagcgggggatgtgacatagaagagacacagaagcatccttatgttattattattattattattattattattattattattattatttgagacacagtctgattctgtcacccaggctggagtgcagtggtgcaatctcagttcattgcaacctccacctcccaggttcaagcaattctcttgcctcagcctcccgagtagctgggactacgcgtgcccgccaccacgcctggtaatttttgtatttttagtagagatggggtttcaccatgttgtccaggttggtcttgaactcctaacctaaagtgatccacccgccttggcctcccaaagtgctgggattacaggcgtgagccaccatgctcagcctgctatcttgatattgagggtacaaggtgaactgggagacctggagagcctagcatggtgcaaagagggcatggtacctggggatttggtgtggtcaaggctagcagaaaggaaaggtgatgggaagaatgtggggaaaagaaagagagatcagattattactgtgtctgtgtagaaagaagtagacataagagactccattttgttctgtactaagaaaaattcttctgccttgagatgctgttaatctgtaactctacccccaaccctgttctccctgagacatgtgctgtgtccactcagggttaaatggattaagggctgtgcaggatgttcgttgttaaacaaatgcttgaaggcagcatgcttgttaagagtcatcaccactccctaatctcaagtacccagagacacaaaacactgcggaaggccacagggacctctgccgaggaaagccaggtattgtccaaggtttctccccatgtgatagtctgaaatatggcctcgtgggaagggaaacacctgactgtcccccagcctgacaccagtaaagggtctgtgctgaggagggttagtaaaagaggaaggaacgcctctttgcagttgagataagaggaaggcatctgtctcctgctcctccctgggcaatggaatgtctcggtgtaaagtccaattgtatattccatctactgagataggggaaaactgccttagggctggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctctgggaaatgcccgataatgatcaataaatagtaagggaactcagaggccggtgtcagcgtgggtcctccgtatgctgaatgctggtctcctgggcccatttttctttctctatactttgcctctgcatctgtttattttccaagtctctctttccacctaatgagaaacgcccacaggtgtggaggggcaacccatcccttcagaagagtagcactttatgatcactactgggagggtcccagaacaaccacttcatgcataggccagccaggacccacagaactctggggagtttcaaacagtcttatttctccgtcctccagcagcatgagatcttgtgttatctttacttttctcataaacttcattgtcacctaggaggaaggttaagagaggggacagaactctgattttggattttcctggctcatttaaatagcctaaattacttagagactgtttaaaggggcatgcaccaaaatttctccatcttttgacttaccagattctttttcctctgatacttctcagaatgaggtcttttaagtaaatgaggtcttttatggtcttttaagtaaatgaggtcttttactgatgaggtctttgaagaccagaacagtaaataaaaaataaaggaggttttttatatttttattttattttattttttacacatctgaatgttgtgtgagtaaatctgcaacctcaccataaagttaagaatttctgttttagggccaggcacggtggctcacgcctgtaatcccagcactttgggaggccgaggcgggcggatcacgaggtcaggagatggagaccatcctggctaacatggtgaaaccccgtctctactaaaaatacaaaaaattagccaggcgtggcggcgggcgcctgtaatcccagctactctggaggctgaggtgagagaatggcgtgaacccgggaggcggagcttgcagtgagccgagatggtgccactgcactccggcctgggcgacagggcgagactccatatctcaaaaaaaaaaaaaaaattctgttttaataatggagagtcagttatgttttttaagcataggtagttggtatgagggacaggatcatattggtgttttcaaaatttcaaagttaatttcaaaagttcactcagccaaagtaagtgaactattaaagcttagagatctttcagagactattatagtaccaaatgccaaaactgattgaaaatactcagattttaagaaaatattttatgataatctgtagtatgtatttatataaatatttatttatttgtatgtatttttgtatctgtagagtttaccactattccaaggcacctagatgaccatgctactaatataataatgttagaagaaaggcaaatctaatttttataaatgctaacccattttgaattcaaaccactattttttaaaatttctcatctcttttcagtggaagaaccacctagtccaagaaattttaaaaaaaaattacaatagttatttttaccacgtgtatcaaagtgcattgcctaaggccatgtactctttcaggaagtgaaaatccataaaaataattctatactaagaggtatgtcaccattctttctcaggccagaggctccatccttaccttgggcattcccaagtgtccaatctgattgttaataactgtcacaatttatgaagttctttgaatatgccttatctggatggttggtaaatcagaataataaggatatttggcccttgaattaattagtaggtgcttgatttgactaatctcttttagtccctactttagctggtactatcttgtaaatcttacttatggaaatggctgacacaaagttttctagtaattttgcttcttgttaccaaatgtattagtcctgtcttatgctgctaatagagacctacctgagactaggtaatttataaaggcaagaggtttaattgactgacagttcggcatggctggggaggcctcaggaaacaaacaatcatggcagaaggggaagcaaacacatccttcttcatatggcagcaagaaggagaagtgccaagcaaagtgagaaaagcctcttataaaaccatcagatcacatgagaactcactaccatgaggacagcatgggggtaaccacccccatgattcaattacctcccaccaggaccctcccatgacatgtggggattatgggaactacagttcaagaggaaatttgggtggggacacagccaaatcgtatcaccagtgatcccttttctcatgtacctaatgcaggaagaaaattgaggttttacattctgaagtgctattccatctttaaaaatcggaactttatttctgcttgaatgtcccattccatattttaatgtaaggggatttgaatcaagtagatttctttgttttatttttattacacaggcaatatatgaatatatgattgttcagaaataattgaaagatatagataagtaaaatagaattaaaaagtcacttataccaacaacagccaggaagtaatcactgttatcttcatcttattgtatattcttcagatttcatattattgttatttgtaaacataaaaagacatcatgcttctttggtttagcaacatattattaaccttctttgccagtaaatattgttttaaaacattattttaaaaggatgttccattatatgaatatgccacacttaataaagccttcatttttgggtgttcaagttcttttaattttttataaatattgcaaacatagctacacaatttaacaaaacacagttgcaaaaacaggtaaatgtttgcatatatcatgaactgctttcttcaaattaattgggaaatgtgtaatgaattcagatgacttaaaattgacccctgttgccattttcctaatcatggaaaagagtaaaatatataagttacctttccacccacaacacagaaaaatgccacataacaatgctaccgtgaggcatctagagagtgaattatgcctcctcaaactcccagtcggactaattaagtttgcataacctgtttcaccatgtggcttggttcacaaggtatggactgctaatgaccaaatgacttattaaaacataaagtactcaaatcagttaaaaacaataataataaagctcaacttggataaatctactggtaaaacaaactacagtttataggacatctgataggaaaaataacagcttttattcctgtacattagctgtgaattgtgattccatttttggctagatcctgactggagcatacaggaagcatccagtaatcagtttgctggtggagtcctaatggtaaaagacaaggcagatgagctaacgactgaattgtggaaagggtcccagggagaccagggctgcatagttcctgtttcttcattcccttttctatgttaagaaaaggagacagagagagagagagagagagagagagaatgagggagaaaaaggggagaggcagaaagagaaagagaggcactgattggcttggcccaggaaatactcaagcagataatttttggttatttcatcttttagatccctgtgtctttgactcttagaggatcagttggagcaaacaatttagaaagtgaacccactaagaaataagctttaggcaatgcatttggagcccatcagagagtgtaactattttggtagtaattataagtgcaaagtggaaaactaaaactcacgtgtccagatctgtctctgattacaagtctgaaagatagagaaaatgagcagtataattgaaaggcagctggcaagtgcagttttatttccagatgacgttgccagaaagctcctctggtttaaaaacacagtcataatttttaaaacaaatcaaactgttaacattttttacttccatttatttatttaaaagataggaatataatatatgtatatatgtatcaggtataccaacgtgtaatacagaggaaattaattaataatataaaatgtaccaaagaatatagaaaataataccatgaatactcatggctagacaaatactgccaaggctctttgtgtttcctcaacaattgcttcatgacatatataagcattgctaaatattacgtaacaattttgtatattctttaacttcatataaatacattttctctgtatgtatttttctgtaacttgatattatatttgtaagaatcaaccatattaatacctgtagcactacgtcatttgttataatgtctattttgcttgacattaatgtaactatatataggtattttggtttttataagttagtatatgtttttctatgtatataagtcacagatttgtatgtgcttttgctttatgtatgcctcttgctacgatgtgaatgtttgtgtcccaccaaaattcaaatgttgaaacctaatctccaatgcaagagtattaagaggtagagactttgggaggtgattagatcatgagggctccaccctcattaatgggactaattcccttataaaagaggcttgagggagtctgcctggtttccatgtgaggacacctagaaagcaacatctacgaggaatgagctctaaccagacaccaaatctgctgggagctttatcttgaacttcccagctccacaacagtgagcaacaaattactattatttttttctttccagaataaattaattatgatactaccagggtcaaagtgaatttgactttcaattttatataatccatcaatgactattctctttttaaagtcttggcagctctttgggggatggaagaagaccatgaagctctaagtgcttcagaggaatggggttgccaaaacagatgtgagaggcccagagaggaggctgggccaatgctgaaggtaaagatccaattcacagttccagctaaacttgaccttacctgtagttttaataaaataaagtaacaactatttctcctaagtgtttactatagcctgtgtaagaagcaaatatactgttggcttagaaaataatgggttattgttttccttttgaacagttttctttttctctttatttttcttacctccaagcagcaccagaacagatgaattcagttttctgtgcatgtattctctggggagagtcagggaggaaatttttacttttgtagcagctggaaagtacatgtttcttcatagcaaggaaaagttgtgtatgacacttcaaaagtggaatccttgagttcctgctggggaccagcatagcagctgcaatgagatcaaagttgcaatagaccccttgctcagaaaaatttagaaaattgaatcccctggaactagatatttattgctttatgtagtttagttcaggttgtgatttcaatgggaatcttcaatcagaactgtaatgaaggtttatcttccttgaaatgagataaatcggcccaaatcatcccctacttgcataaacatacaatttcaggtaacagtcactggttggtaatgtttctctattttgtatctaatgcctgctctatttgttctctcctcctagggtattattttggggctgagtgcagaaataagagatgcgtgctaaaaggtcatcggtttagaaccagccctagatctcctgggatcctgcccagctgaatcttcctccttgtaacatgggctttgggaatttgtgagagatttaaataaagtaagagacacttaggaaatgaattcatagggcactggggaaaatgctgagcatataggggcaggaactatggtttgagcagagaggaacaggagatatggagatatttatagcaatgagttgccactcagttcatatcggatgactaaaatgaggtgtgtctgccctctgagtaacctgaatggaagaaagccttttcaccttttatctgcagtgagtaggtgctccatagaatgttcaatcaaatctgaactgaaagaagcattttaaattcacacttcaagagatcacagaacaaacagaaattagcaagagattttaatttcaattttctacttgtgatagtctggtaagaaaaaactataaaataaaataacaacctatattctagttagtctcaagcagaatttttggggcttgctattgaaagttctatgtaatcattctttatattaaaagtatatttgcctaggctcggtggctcacgactgtaatcccagtgctttgagaggtcaaggcaggtgggtggcttgagcccaggagtgcgaaaccaacctgggcaacagggcaaaaccacatctctaccaaaaatacaaaaattagctgggcattgtggcacatacctgtagtttcagttgcctgggaggctgaggtgggaggctgaggtgagcccaggaggtcgaggctgcagtgagcagtgaccatgccactgcactccagtctgggtgacatagtgagaccctgtcccaaaataaataaataaataaatagacaaataaatgtatatatattgtgtatatatatttgtaaatatatatatttataaataatttttatttacaaatatttacaaataattaacccgtggtctgatgacctattcagaaacttgtaagtgatgtgttagccctagcgttgctatatccctatttattttcttctcttaaccttccacacactgtgttttattaggatttactaaagcaatgtcttcaaagaggtgtttaagaaggagaggttggtcggaaccagaaaatgcattcctgggatgatctttgggatacacccaactgaccctctgaaaaggtcagccacatgtatttaataattatactatatcaccaaactccaaagtcagggtggaacttatctaccaaatctcagccttccaagccaacagagttactttctgatccctactatatatcacactagaaaataagtatgtagaccttattatcaaagtggctatgcatgctcaaaacacaaacgagtttaaaatgatttataattgttgaagcataaatttgagataatgctgtctgtttttgaagggcttatgaacttagaattgtttttagattttttaatggttaagaagaaaagaataacatttcatgacacatgaaaagtatttgaaattcaaatttcagtgtcaataaagtttgattgatgacagtcacactcattcatttatgaattgtctatggctgctttgtactacaatggcaggattgtgtacttttaacacagcctaaaatttccagtatatggccttttaaagaaaaaagtttgatattccttactttatgcccttgtcaagtagaatcagtagaatccagggtctccatgggtcagatccaggtatggctatcccctgttctttcttttgtatagcaatgtatataaatggtctttcctctggtctgtatggccaggagcatagcttgagtaaccagctataatgttttctgatattccagaatatcagataggaagaactcacagggacactccaaatgtattctgggggacactaaatgtattcacagggacactccaaatgatattctggatgggaagaactcacaggaaaactccaaatgtagtacaatctgtatgtatatggcacttcagtccatttatggactgaaaagttgagaagcctatttctggcatagcactatattctggcaccacataggcatcataaaattttaacttgaattttgctgtattaagaatactacctctgtgatcttcttatttggtcataatttctttgagttttttatctttcaaatagctaagccattattttggaatgttcagacttgtagatttttttttttttcagttaattcccacaattcggagtggaatttgcatgactttagactatttaaagtgatttcacaggtttactggggcatccaaagtcaagtaaaactgtgctaacaatatgacatttttcctttggagttacattctggggaactgaaattctatttttctattcccagtgttttgggaaaccaagaatactggcttcatagcagcaaagacagcgaataatattctgtgctcaacgttccattggtctgagagtaaagggaaaagggttcagagccatttctgcctccaactagttttgtggctttatgctcctcatttaacttatatggaccttagtttcttttttaattggcaaataataattgtatatattaatggggtccaatgtagtattttcatatatgtatacattgtgggataatcaaattaggtgagttagcatatccctcactgaacatttgatatcctcttttaactgttttaaaatatataatacgttattattattattattttttttttgagacggagtctcgctctgtcgcccaggctggactgcggactgcagtggcgcaatctcggctcactgcaagctccgcttcccgggttcacgccattctcctgcctcagcctcccgagtagctgggactacagacgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccataatacgttattattaactgtagtcaccatgctatgcaatagatcaccagaacatgttccttatgtctaactgaaaccctgtaccctttaaccaacatctcccctttccttgtctactcctgcgccccaatcattgccaacctctggtccattctactctctacttgaatgaatttgactttttttagatttctcataaaagtgaaatcatatggcatttgtctctctgtgcctggcttatttcatttagcctaatgtcttctaggttcatccgtgttgtcacaaatgccagaatttcctctctctctctctgtgtgtgtgtgtgtgtgtgtgtgtgtgtgtgtgtgtgtgttaagccttaagagtattccattgtgtatatatacgacattttaaaaatccattcatgcttcagtagacacaggttttttgcatatcttggctcttgtgaaaaattcttcagtgaagatgggagtgcagatatgtcttcaaaatactgatttcaattcctttgggtatatactgtaccccaaagtgggattgctggattatattgcaattctttttatagttttttgaggaagctcaatactgtattccaaaatggctgtactaatttataatatcaccaccagtatacaagggtttctttttctccacatcctcgccaacacttaccttttgtttttttgatccaattgaacaggtaggtatgaggtgatatttcattgtggttttgatttgcatttctctaatgattagcgatattgagaatttttttcttgtatctgttaactacttctgtcttcttttgagaaatgtctattcaggttttttgtacatttttaaataggtttatttgttttcttgttactgagtaatttgtgtccttgtatattttgaatattagcccccttatctgatgtacaatttgcaaatattttctcccaatctgtgcattatctcttcactctattgtttcttttgctgccctgaaactttttagttgaatacaattatatttgtctatttttgcttttgttgcctgtgcttctgggattatatctgagaagtcactgttacagacctgtcatggaactttccccctacgttttcttctagtagatttacagtgtcatgtcttacatttaagtctttaatccattttttactttattcttgtataagagtgaaataaaggtccttttcatcctttttcatgtggatatccagttttcccatttattgaagagactgccctttcgtcattttgtcttcttggtacctctgtcaaaattgactgtagaggtgtgggtttatttctgggctgtctataccattcggttggtcagtgtgtctgtttttatgccagtacattctgttttgattactacagctttgcaatatattttgaaatccagttgtatgatgcctttagctttgttatttttggttatgaatgctttggctattggggtctcttgtggacccatatgagttttacaattgtttttctgtttctgttaaaaatgacattagaattttgatagagattgcattgaatctaaagactgctttggtagtataacattttaacaatatcagtccttcaaatccatgaacacagggtatcttttcttttatttgtgtaatcttcaattaccttcatcaatgttttatagttttcagtataaagatcttccatctctttggttaaatttactcataagcattttatttatctatttttgacactattacaaatgggattgttttcttaatttctttttcacatagtttgttattagtatgtggaaacactacttttttttgtatgttaattttatgttctgcaactttgctgaattagttcattagttctaacaagtttttggtgaagtcttctgaattttctatgtaaaatatcatgtcagtaaagagacaatttcacttcttcctttcctatgcagatgcctttttttttaattgcctaattgttctggctcagatttccagtactatgttgaacagaggtggtgagagtgggcatccttgtcttgttcctgatcttagaggaaaagctttcaatttttcactgttgagtacaatgttagctgtgggcttttaatatataaccttagttgttttgaggaacattccttctacacctaattttatcataaaaggaagctggattttatcaagtgctttctctgcatcaaattgagaaatcatacactttttgtccttcattctgttaatatggtgaatcacatttattggtttgtatatgttgaaccaaacttgcattacagagataaatcgcacttaatcatggtgagtgatccttttaaagtattgttgaatatggtttcctcgtattttgttgtgaaattctgcatctgtttgtcagtgatattggcctatagttttcttttttcatagtgtctttgtccagttttagaggaagagtaatgcagcctcataaaatgagtttggaagtattctttcttcttcagttctctgggagagtttgagtataattggtattagtttttaaaaaatatttcatagaattcagttatgaagccatctggttctgggtttttctttgatgggtgacttataaagcctgatttagtactctgactcattattggtctgtttagatttccagtttcttcatgattcagcgtggtaggttacatgtttctaggaatttatctattttttctaggtcgttcaattcattagtgcataattgctcacagtagtctcatgattctttctctttctgttatcagttgtaatgtctccttttttattttaaattttatttatttgagttttttttttccttagtctagacaagggcttgtcagttttatttagcttttctaaaaaccaatttcttaattttattgatcttttctattggttttctagtttctgttttatttatttatgctcgatctttgttatttccttccttctgctaaccttgggcttagtcatacttctttttctagttccttaaagtataatattaggttgtttatttgagatctttcttctttttttgatgtagatgcttattgctataaacttctctcttagaacagcttttaacatatcccataagtctggtatgttgtgtttccattttgatttgtctcaagattttaaaaatttctcctttaatttcttctttaacccaacagtttttcaggggcatgttatttaatttccacaaatgtgttcattttccatgattcctcctgttcttgatttttagtttcataccactgtggtcagaaaagatagttaatataggatcttagttttcaaaattatgaatcaatgtagcttgactagatgaccttgatggccacctacaactgtaaaatataatgctcttattttaactcactgaagattgccctcctcctccactgaattgactcagaatacttaggattttgtcaagttatatatttgctgcctatctatctgaaatttagtggaattttgttttgtttttaatgcaattgaactattgcaatgaatagatataatggaaattttgtagtgaaatgtttttcactacatttaaagaaaagtcactggatggcagttaattatataaaagtacaaagacagtaataataaaataagtaaatataagataactagctgtatgtatataaactaagaacattctgatggtaaagatgggcatgagttaaaaaaatttctaggcattatatttaaaacaatctgcctgcactgatctaaataaaaacagcttctcaaacttccatcttcttctatatcaccatgtttcaggattaaattgttgttgtattttttgactattaaaggcacaacatttgtcaactcaacactcttcagactttatcaataacaaaaagttgctaatgcttgatgagatgatgagtgagaaggtgggaggcagaagcagccaacagagaagacaaaggatctaagaaaatgagagagaaagaaaggagaaaaatatgtagaaatttcaagttgatgataacattctaagaccagatgaacacttactttattttctggaaaagaatcattgacctcatgaaacacattgtgaatgtgtttttttcttcctgactcaacctatgaacaggacattgaattcaagattgactacaaagttaataattacataaaattatataaaataaaagtacgaaggcaataataatataagtaaatataagataactatgtataactatatgtacaactatatatacatagtttgtaactatgtctacaagctgagaacagtctggtagtaaagatgtgccaatataagaaagttctatttgatgttgaccatgacaaggcacacttcatcccgaaggcatttttgacggtaaatctaaacagcctgttttctttttcaaagagtttactggtgagcagccagacatttgaaaatagtttctgtttttccacagcttgaagatcgaatcagaaaaagtagtacaatcattttgaaaataaatatttttaaaacaaatctcttggacgatgatttgttttatataaacaaattatatgtaatatatttttattccttctctatataaaaatacttactttaggcattttgctatgttgtattaagaaaatgtctcctccaccccactgccaaggggctgtttctttcagatgaaaaggttgttcttttcttaatactagctaggtcactttggtagtttgctgtcaggacatgaagtattattagtgttctctcacttgccaatgaaggtaattttgaatgcctccagtcagcattttgttttggaaagaaaattgattcaggatctaatgcttgttgagattatgggaataattcaccaatctgtgcctcgtctaaaaggaaagcagtggacataacttaccattgtccatctttaacattttatgattggagtaaaaaccagagagaaatgatgtaatgcttgaggcaaattattacactcaaactctttcatgttgtatctctagtaccctaaggatggagctgtccatgactgtcagctgacagtcacattattgccttgtaaggtaagaaaaggttactttatttaacttctatgaaccaggatatgcattacttgttaaagatacaaaaccaaataaattgtgactcttgtccctgagcaagtgtggcagtatttgcagatgaagttgtaaacagagttaaactgttatataatagtaaatagaaagcatacattcaaacgaaattattcagggattgaaaatatttgctgattatattagtttcttattgctgttgtaacaaagtaccaaaacttagtgattttaaacatcacaaatctattattttatagttctgaagtcagaagtcaaaatgagtcccaaccaggctaaaatcaaggatttggtcgggctgtgtttctttctacaggcaccaagggaattcattttcttactttttccagcttctagaggccacctgcactttttgcttcatgctagccctctcctctcttcaaagccagcaatgaacagtttagtctttctcacatcatgttactctgacactgactcttctgactcctctttcacttataaggactcatatgattacctatcacccactagaaaatccaggatagtctccccatctgatatggtttgcctatgtccccaaccaaatctcatctttaattgtagctcccataattcccacatgttgtgggagggacctggtgggagataactgaatcatgggggtgattcctccatactgctctcatggtagtgaataagtctcacaagatctattggttttataaggggaaatccctttcacttggttctcagttgctctcttgcctgctgccatgtgagacgtgcctttgccttctgccatgagtgtgaggcctcccagccatgtggaactgtgagttcattaaacctcttttacttcataagttacccagtctcgggtatgtctttatcagcagcatgaaaatgaactaatacaccttctcaacattaatttattaacaattttaattccatctgcagccttaattccttcttgtcatgtaacatagcatattcacagtttccaggaattaggatgtagacatccttaggaagctattattctgcctaccacattgatgggactataaatcttgggttttcatgtagctttcatgaccaattccagttaatcttactcatgcaatggtcatttaaaaacatgcaattagttccatgaatttgaagtcctcaccaatctgatatgagcctttaaaaattcatccagaacagaaaggacaactggattagaacattgctggcatggcttttatgagaactgcgtgcctatagtcccagtctgtatgttcaattctggttcattctgaccgtgtgttgcttcagtatgtacaactccaaggaactgatgttttcttagcaccatctgtttattacagattatgagtcatcagttggctcccagaaccttaaggccttagacactttaatattaattcataagtctttgtgagtatgaaccctgaaaatctgagacaggtctcagttaacttagaaagtttattttcccaaggttgaggatgcatgcccatgacacagactcaggaggtcctgatggcatatgtccaaggcggtcagggctcagcttggttttatacattttagggaggcatgagacatcaatcaatatgtataggatgtacattggttcagtctggaaaagtgggacgacttgaggcaaagatgggacaactcaaagtggggagggggctcccagatcaaaggtagataagagacaaatggttgcattcttttgagtttctgatttctgtcactcaggctggagtgcatggcctgaccccagctcactgcaatttctccctcctgggttcaagcaattctcatgcttcagcctcccaataagccggaattacaggtatgcgccaccgtgctaggctagtttttgtatttttagtagagacgggttttgccatgttgaccagctggtctcaaactcctggccttaagcagtctgcctgcctcggcctaccaaagtgctgggattacagttgtgagccactgcacctggccagtggaaacacatttaaatgctcctctcttttgaaaacaacagttatttttttgaactgtaaaggaaatacttgttaattatagacattttgaaacaattctaaaattcaaagaattaaaatcatccataactcttttacctacttgtagttaggtttttgttatattttctctctagtcggtaataatattttcttgaatgatgtgaaaaaatcagtagttcttggtgttttgtggttttttttcattatttataattcaatcagcctcattttaccaatttatttccaactcaataaggagttgaaaattttatatacagctagagcctaaaaatgataaatccaattttcctgtcttacagaaatttggaaatggagtttacataagcattacctttctactcttcctaacctgtagggccactacatggcatcttttctttttaataaaaaggaaagaaaagtctaagtatttatttagagcaaacattctgttagccatgggaaaatgaaaggttataaaacacttgtcttcaaagagtttatagtgcagttgtataggaaggcacaccttcaaagaaaatgtcaatgcaactggaagatgggctctaaggacccagcctctctaatggaggaggtaacattgcccaaagaatctctttccagagaggattaaagcttcctctctttggttataagaacatggcaggtgccaagtgttcatcctggagggtcaccagaaaatgatgggccggtgaatctggagaagtacaaaactgggtcaggtatagtcagttcctgagagaatcatggtaccattcaccaagataagtaaatcccaaggaaagtggacattatttttctgaaaaggaaaatgaatgattttttctggacatgattgactgtgatcctgtggtgatatcctgcatcaggtatcaaagaatcataaatcaatgaacaattaatatttgaagggattttagagtcaattattgtgttaaaattttttcattttagacatagtggaagataaatttccaagagatttaataattttgcaaatgccaccaaacaagttggttgtagaagtgggactaaaagataaattccttccttttatgctaccagtgtggggaaaagaaagagagatcagattgttactgtgtctgtgtagaaagaagtagacataagagactccattttgttctgtactaagaaaaattcttctgccttgagatgctgttaatctgtaaccctacccccaaccctgttctccctgagacatgtgctgtgtcaatttaaggtgaaatggattaagggctgtgcaggatgttctttgttaaacaaatgcttgaaggcagcgtgcttgttaagagtcataaccactccctattctcaagtacccagagacacaaaacactgcggaaggccacagggacctctgccaaggaaagccaggtattgtccaaggtttctccccatgtgatagtctgaaatatggcctggtgggaagggaaacacctgactgtccccaagcccgacaccataaagggtctgtgctgaagaggattcgtaaaagaggaaggaacgcctctttgcggttgagataaaaggaaggcttctgtctcctactcatccctgggcaatggaatgtctcggtgtaaagcccgattgtatattccatctactgagataggggaaaaccgccttagggctggaggtgggacatgctggcagcaatactgctctttaaggcattgagatgtttatgtatatgcacatcaaaagcacagcacttttttctttaccttgtttatgatgcagagacattcgttcacctgtttacctgctgatcttctctccactattatcctattgtcctgccacatccccctctccgggaaatgcccgataatgatcaataaatagtaagggaattcagaggccggtgtcagcgtgggtcctccgtatgctgaacgctggtcccctgggcccatttttctttctctatactttgtctctgcgtctgtttattttccaagtctctcgttccacctgatgagaaacgcccacaggtgtggagtggcaacccaccccttcataccagcacatgggaggtatcagaaatcctgagtttttgttctttgttctttggtgatggtgggttcagttgtctcagataatctcaaaagggaattttggacaaggtaacccccaacattctttccagctttgatagtctgctaccatcagataagctcaggagaaatgagtcttgcggaagaatggatttgtaagcactgagaatgtttaagatccctgagggaaaaaatgatgacagggatcaagatatcaatgattaacctttgtgctactctttgatatacggtgtggaagaaagaagagaaaccacaaaggacacccacagagaagtgggtagtgaagtagaagaataggaataggcctgggactgaaacaaaaggaggggctgaagaaggactgattaaatatggcaaatgccacagacatcaaggcggatgggaactgggaaagggcaacgagattttataatgagattggacaacaagagtctttgtatataaaatatttaaagtacattgattaaattatctatgagaagatggatacaaaagagaaaatattgaatgtaggtagttggaagatatataagagtcagagataaagtgtatagaattgggcaggctataagcccaattgcaggcagaagagatgaagagcaagagattgaaggtttgtgaaagaggatttgtctgatggcatgaagttccagaagaggtggaagatggggaatacccttaacacagatagagaggctgatttgggcaaggagaagggcacctcttcctctgaaaaaggagtataggaagagtaggcacctgaaaacacagagaaatttagagttctgtggacacagagctggtttgaggtgggggaaagagtatacaaagcattttgtgacaaagaatttgtcttcttagtcattatggtggcaacgcccaggctgagtggtgagactgagtagctgaggactgagcaaaaagatccaagcaggggctggagggagagatccacagagagttaataaaagaatggggagctgctgtaaagttaggtagaaaatgtttcagtgcttctctgatgcataattttatgaccttgattttaatgtttggagactgagggtagaactgtagaaagcaggtttcccagggctagggcttagcagaactgaaaattaaaggatagaagctgccggggactccaagcagcttaaagttgctgatcatgtgtctcaggctgaacagtgaggtgatgaagtggtaaaggtactaatgagctagataaactggtgggattaaggggctggccctcacactaggggagcagcaagatcagtaacatgagggaatgggaaatgctaggtcagaaagtcgtggctggagagaaaaatagttgagtgaaaggaggaagcagagaaaatggcttatgaaataacagatctctgaccctgtggagctcacataccatcggagaaaccatcagtaaacaataaaaataataaatgagaagattacttagcagtatgaggaaaaggggagaggagagcagagtaagggagattgggactgccaggggagggggacgggaaggaagttttcacagtgtggttgtcaggcgtcactgaggtgtgatttgagtaaggatggatggaggtgaaggtggtccagggcaagagagttctaagaagagtgggcagcgtggagtgtgcgaggcatagcagggaggctgtccactgatttttgctacattgtgttgctgggcttgtgccttctctgagctgcagagctgtgaatctctgcttttatgtcgtgactagagcttggaatggtgcatgctctgtcccggatccctttcctctacgtagtagcagtatccacattgttgtttttgtgccttacttctaaaatacaagagtctgtatcgcaggtattaggtgtgcaagttcctggctgtgaaaaaaaataataattttctacctaatctgatcttaagctagaggaatagactcagaaatggagcaaatgaatctttacccttttgcgatttggatattcagaagaatagacttttatctattaaaatgtttcactgagactgtaagtctttattggacagtaggggtttagaattaatagaatcacccaaaagatctcagtaacaaaatacattcttagtaactgatatgagaattcttctgaggaaaaaatacttgctgttaaaatgcctggctggataggccctgaggaattcatagattttgacgaaggctttggattatgaagttatgaaattgaggggttgagtcaagactgttaatttcttcaggagtcagagaggcttgatcttggatctgaattatataggagttaagagtaatttggaaattgattcaagtcagaaaatatattaacagtggctattcatttgttatgattatgcacattctattatgcattgctgacattcaaagagaaccacctgacatggaattttcccttaagcacaagaattctttcgtaaatgttccctaagtatctataataatgaaacaaagaggatttccaaagatcaaacaaactttttaatcaacaattaatcccaggaacaagttgtaaaaatacattcattacaggaaagccacgtttaccttagcattctaacaaataattaatttgaaatagagtttgagtaaatttgtaatcaaagacaagaacaaagcccagaagtcagggtgtgagtgacagtattgcttgataaaactccctgggatttctgtagtctgttacatgtttgtttataggagctcagctgagaatgttcaattcatcaaaacaaagttatctttccaagatgttcttataaacgccattaagaccacattgtctaagatgaactcctgtccagacagaattggaaactgacatgtaattttccaacccatatagctagtgaagttggaatcttttaatgtaatttctattaactggtgactgccaggagattataaagaatttatgttcccagataatataagtgctcacaacttctgcagggaaatctcaaatcatactcatttactgtatcatggtctaggccggaaggttatctgtcttcagtagccaatattcaaggtagcagttggctttgtttttgctttctctctttaatgaggttgctcagcttaaaatgtgtgtccccacccctcccctctactcccttccccttccctcccctctcttcccctccccttcactcctctctcctcccctcatcttccctcccctcctcttctttcccctctcctcccctcctcttccttcccctctcctcaactctcctcccctcctcttcctccccctctcttcccctctcctattctcccctcccctcccctcccctcccttgccctcccttctcctcttctctttcagttcccagggaggtagcaaaaacactgaatttctaaactgccatcctaattgataaagtttaaagtccaagagctttaatgtgccactgtgttcttctgaaaccctgtttgtaacatgtcaatagctttttgatgctcttaagagctcagggaaaacacatatgattcttctatctgtcaagcgtcaccttctgacaatctcacctcacacaccaagcatcatacgagggaggaggttgagtcaggaaaaaatttctggtggaagatatatatatatatgtgtgtgtgtgtgtgtatgtgtatatatatgtgtgtgtgtgtatatatatatatatgtaaaagctaaaaaccaatggatgaacagaagctacccaggcaatgaagacagctaagagtgttctggaaaaggggagagatatcaaaataatttaaatatggatcctatggatccttgtaatatagttcagtatggatcatagtagcacattaaagctcttggctgcattgtagtgaataacctaggggataaaatggagataagcaagtgaggtgataacccaggtgagtaattagggtgactcagaatagggcaattgtgggggctattggaaagagacaaatctgaaaaatgattaggaggtaagttaaacaaaatttgattttcggctgaatatgagagtgaaggagagaaaagagtgagggaaaactcaggtttccagcttgagtaattggttggagagtgacgttattcactaggaaagggaacacctagggagaagctggttggaagaaaggtgaagatggtgagttcagttttgaatatgttgaactttaaatgtccagaagccatcacagtagctgtgcccaatagacaggtatgcacacaaggctggggctcaacagagaaatctagcctaatgatttaagtaaatattgagaacgtgtactaagtattacagcaatattcaatttttatgccatttccattgttcatcaaacatcgtagaagatttaagtcaggcataacatttattttgactcatcatttccttaatatagacctggtttagattttattgtttacaagatatttgaaatcagaactttgtgagcatattcgtccagttgttacacattttcatggcaaaagtcttttcaactttctgagtaatagtattaagcattatggtaaacagtcaaagggtgcaaaactatgcaaatgtcccattctgagtagagtgaaaaagttcgtggtataaattaagcagatgtgttatactaatgagaacaaaattagccttgacacatttctggcaggtctagagaaatagaagatatgttctctaccacacacgaagtgttgcatcagggtaaccaaggatatcattgttgagcctagaaagtgccaggaatatgctctacttggacaaatcctgcctcccagtgggaccagcgtcaaaacctcagtgactttccaggttgaaccaattgagagattttgaaactgtcttgaagatcagactggaaacttaggcaccaccattgaagaacttaagaggtgataaattccacagggatgtgcatttggtgaagactggccactttagtaaacactaatcagctcttatatatagaagtagaaaccacagagaactccaactgcattatcagacagaaaaaacaaaaagcattgaatgttactttgattttgtccacactttcttttctttcccaatggatagagtcatagaaatcattctagaaaataaaatgggaaatgcaaatgttttctaactagatggcctaattttggagtacttctaattaactgaacattggatgaaagggacttgggctttctgtcttctttagtaaactttagggaggtggaacttgtaaaatgtggtggggaaaaggtctaaatttcatcatttctccttaaatctacaattaaaaatattgtatgttccctaaaattacacagaccgatttaatttggaaattcttataatggtatattttagttattctgagaacataattacctgcactgagtatatttttaaggaaatgactatttcccaaaagtattgggtacaataagctgccattccgagcctcagatacattggaacatgttttcatgctactacttttgataaagctgatttgaatccgaataaattgtcaataaagagaacacagacttgtatgggttttattttacatattcttacatgtaaaatgagaattttaaaaattattaaaaggcaagtcaaatgcctgagttactgattataattaacaatttttggaagaagaaataagaatgtaatctcttttttgtttgtttgtttttgagacagagtcttgctctgtcacccaggctggagtgcagtgtcgcaatctcggctcactgcaacctccgcttcccgagttcaagcaattctcttgcctcagcctccggagtagttgggattacaggcacccgccaccacgccaggctaatttttgtatttttagtagagacagggtttcaccatgttagccaggctggtctcaaactcctgacctcatgatccacccacctcggcctcccaaagtgctgggattacaggcgtgagccaacgcgccctgccaagaatgtaaattttttaacgtagaagaaggcatcagcctgattctgaagagcatattggtattcactgattagattagcaaacttaacatcaacattccaaatcactactaagttattttcttacaaaagccttccattattaaccttaaaggccgaagtaaagatttataggactaagtgtttgctttagtcttttggtacatagtgatgtgatagaaattgttgtgtgtgtgtgtgtgtgtgtgtttgagacggagtctcgctctgtcgcccaggctggagtgcagtggcgccatctcggctcactgcaagctccgcctcccgggttcacgccattctcctgcctcagcctcctgagtagctgggactacaggcgcctgccaccacgccctgagaattttttgtatttttagtggagacggggtttcaccgtgttagccaggatggtctcgatcacctgacctcgtgatccgcccgcctcggcctccaaaagtgctgggattaccggcgtgagccactgcgcccggcctagaaattgttttttttttttttttttggtggcgggggcagataggctgccagggtttttatgttgctttattaaaatcatttgtatactgctgaggctggattttaaagctgtaattctgacccattttcctctgcagtttgaaaggaaacaaaacaagaatgaagtctcagctgaaaattactttcagtctgatcccttgggccttggcctcccaaagtgctgggattacaggcgtgagcccggtcgcctggcctagattcttttttagcagacaatgcacctatcactcatttgctctagtattggctgataacagcccttattctaatagccccttcctttaaagaattgcccttggcaggcctggctcagtgtctcacatctgtaatcccagcactttgggaggccgacgtgggcggattacctaaactcagtagttcaagaccagcttgagcaacatggggaaacactgtctccataaacaatacaaaaacaaaaacaaaaacaaattagccacacatggtggcctgcgcctgcggtctcagctacttaggaggctgagggggcagaatcgcttgagtccaggagatcgaggctgcattgagccaagatcatgccacagcactctagcctaagctacagagctagatcctgttttttttttttttaaattgcccctggcaacacctgcctgccaggaaagcaccaacctaacctccaccctgcatggaggtataaaaggctggctcatagcctcaaggtcagtctacttctctggtagaatttcttttcccaagggatcagagtgaaagtaattttcagctgagacttcattcttgttttgtttcctttcccctgtatatccagctttcctcactcaattttttctgaagtacgccctcaacaagtcacataaaccagaatcttcatctcagtctttgtttctaggaaataagacccaatataagacggtaaagtccaatcatgcactaaagctgtgtagtccaatgtggtagtcacgagccacctgcagctattaaataaaataaactaagaattcagtttctcaaccgcagtagtcacatttcaagtgctaaagagtcacatgcagacatcacaaatatagaacattccaccattgcaaaagcttctattggatagcactacactaaaggctctgtgccctgaaatgtttcctctatttctactcctcccccttaaactctccaagaagggcatagttagtgcacaagtgtagtttgagacttcaacattcctctctcagtaattgatagagcaagtagatataaatcaatacagatagagaagacttgaaaagtgctatcaaacaatgtgacctaagatataaatagaatattcaacctctcatatcagaatatatcacctcaagtgcacatgaaatggtcatcaaaatatacaaattttaaccatgtaaagtaattgaaatcatccaagtatattctttgataatcatgaaataaaaaatggaaaataatctggaatatcttcacaatttgaaagttgaacaaggcacttctaaaatatttcgtggttcaaatagaaagaaaaattagaaaatattctgaattgaatgacaatgcaagcacattatgtggggtgcagctatagctacacttaaaggaaaactcacagcagtaagggatattttagaaaggaccaaattctttatattgatgatataagtttcaccttaagagagaaaagagtaatttaattcaaagcaagcagaaggagacaataaagaataaaaagaaaaaggataaattaatgaaattaaaatcagaaaaacgccagaaaaaatgaatgaaacaaaaaactggttctttacaaaaatcaatgcaatttatagacaactttatgtcataaattgaaaatctttagataaataggcaagttccttaaaggacacacactaccagtgctcacttaaagagaaatagataaccttaattgtcctatacctattaaagaaattgaatttgtggttaaaaccttccagcaaaaaaaaaatctgtggttcactaataaattctacttaacatttaaggaagaaataatgctaattctatgcaagctcttatagaaaataaaaaaagaagaggccaggcatagagactcatgcttgtaattccagcaccttgagaggccaaggtgggaggattgctttagcccaggagtttgagaccaggctgggcaacatagaaagactcttgtgtctgccaggaataaaaataattagctgggcttgatggtatgcgcctgtggtcccagcagcttgggaggctgaaatgggaggatggcttgagtctgggagggcaaggctgtggtgagccgtgattgtgccactgcagctcagcctacgtgacagagtgagaccaagtctcaaaaaaaaaaaaaacaaaaggaaagaaggaagagagggagggagggagggaaacgaaaaagaggaaactttatcactcattcaattaggctggcattactgtatacccaaactagccaaagtcattagaagaaaacttcatatcaaaaccctacatttacattgacagtataatcctccactaaacattagcacactgagtggagtaatatgaaaaatgataatatatcatgaccaaattcagtttattctagaaacacaagtttggtttgaagtttgaaaatgaattgatattattcaacatatcattcaacataaaatactaaaaaagaaaagtcatataatcatctcaatagatgcagtaaaaataattgacataattgaatattcactcatgatctaaactctcaataaagtaagaataagcagaaacttccttactgtgatagagggcatctttgaaaaacattcatttgccgtcacatttaatggtgaaagacttttcccttaagactgggacaaaagcaaagctgttggctgtcacctttcctattcatcattgtcctagtcagttcaataagggaataaaataaaataaaaagcattcagactggaaatgaagttgtcttcgtaagttatgtgattgtgtctgtagaaaattccaaagaatctacaaaaaatgactaagactaaaaagtgaggttagcaagtttacagaacacaagattaatataaaaatcaactccatgtccatatataaaaaatcactagcaatgaagaattggaaactgaaataataatagttctattatgtctgtggcctgtatgtagaaaactaaaaaaattgctaatgaagtgtatcaaagaagacctaaataaatggagagatatactgtgttcttatattagaatattcaatattattaagatatgaattctccctaatttgatttatagattctatgcaatcccaataaaaattctagcagaatttttaatagaaatttacaaaataattctttttctcatttacatttactcaatttatttatctttaatagtttatctgtattactcatgagaacctagacattagacaaaactaatcaacccaagttattctcctgttaacctttttttttttttaattatactttaagttttagggtacatgtgcacaacatgcaggttagttacatacgtatacatgtgacatgttggtgtgctgcacccattaactcatcatttacattaggtatatctcctaatgctatccctcgcccctccccccaccccacaacaggccccggtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatagctgcatagtattccatggtgtatatgtgccacattttcttgatccagtctatcattgttggacatttgggttggttccaagtctttgctattgtgaatagtgccacaataaacatacatgtgcatgtgtctttatagtagcatgatttatagtcctttgggtatatacccagtaatgggatggctgggtcaaatggtatttctagttctagatccctgaggaatccacacactgacttccacaattgttgaactagtttacagtcccaccaacagtgtaaaagtgttcctatttctccacatcctctccagcacctgttgttccctgactttttaatgatagccattctaactggtgtgagatggtgtctcattgtggttttgatttgcatttctctgatggccagtgatggtgagcattttttcatgtgtcttttggctgcataaatgtcttcttttgagaagtgtctgttcatatccttcgcccactttttgatgggattgttggtttttttcttgtaaatttgtttgagttctttgtagattctggatatcagccctttgtcagatgagtagattgcaaaaattttctcccattctgtaggttgcctgttcactctgatggtagcttcttttgctgtgcagaagctctttagtttaattagatcccatttgtcaattttggcttctgttgccattgcttttggtgttttagccatgaagtccttgcccttgcctatgtcctgaatggtattgcctaggttttcttctagggtttttatggttttaggtctaagatttaagtctttaatccatctggaattaatttttgtataaggtgtaaggaagggatccagtttcagctgtctacatatggctagccagttttcccagtaccatttattaaatagggaatcatttccccatttcttgtttttgtcaggtttgtcaaagatcagatgtttgtagatgtgtggtattatttctgagggctctgttctgtttcattggtctatatctctgttttggtaccagtaccatgctgttttggttactgtagccttgtagtatagtttgaagtcaggtagcatgatgcctccagctttgttcttttggcttaggattgttttggcaatgcgggctcttttttggttccatatgaactttaaagtagttttttccaattctgtgaagaaagtcattggtagcttgatggaggatggcattgaatctataaattaccttgggcagtatggtcattttcatgatactgattcttcctatccatgagaatggaatgttcttccatttgtttgtatcctcttttatttcgttgagcagtggtttgtagttctccttgaagaggtccttcatatcccttgtaagttggattcctaggtattttattctctttgaagcaattgtgaatgggagttcactcatgatttgactctctgtttgtctgttattggtgtataagaatgcttgtgatatttgcacattgattttgtatcctgagactttgctgaagttgcttatcagcttaaggagattttgggctgagacgatggggttttctaaatatacagtcatgtcatctgcaaacagggacaatttgacttcctcttttcctaattgaataccctttatttctttgtcctgcctgattgccctggccagaacttccaacactatgttgaatagtagtggtgagagagggcatccctgtcttgtgcccgttttcaaagggaatgcttccaatttttgcccattcagtatgatgttggctttgggtttgtcataaatagctcattattttgagataagtcccatcaatacctagtttattgagagtttttagcatgaagggttgttgaattttgtcaaacgccttttttgcatctattgagataatcatgtggtttttgtctttggttctgtttatatgctggattatgtttattgatttgcttatgttgaaccagccttgcatcccagggatgaagcccacttggtcatggtggataagctttttgatgtgctgctggatttggtttgccagtattttattgaggatttttgcatcgttgttcatcagggatattgttctaaaattctctttttttgttgtgtctctgcccggctttggtatcagaatgatgctggcctcataaaatgagttagggaggattccctctttttctattgattggaatagtttcagaaggaatggtaccagctcctccttgtacctctggtagaatttggctgtgaatacttctggtcctggactttttttggttggtaggctattaattattgccttaacttcagagcctgttattcgtctattcagggattcaacttcttcctggtttaatcttgggaggatgtatgtgtccaggaatttatccatttcttctagattttctagtttatttgcatagaggtgtttgtagtattctctgatggtagtttgtatttctgtgggatcagtggtgatatcccctttatcattttttattgcatctatttgattcttctcttttcttctttattagtcttgctagcggtctatcaattttgttgatctttcgaaaaaccagctcctggattcattgatctttggaagcgttttttgtgtctctatctccttcagttcttctctgatcttagttctttcttgccttctgctagcttttgaatgtgtttgctcttgcttctctagttcttttaattgtgatgttagggtgtcaattttagatctttcctgctttctcttgtggggcatttagtgctataaatttccctctacacactgctttaaatgtgtcccagagattctggtatgttgtgtctttgttcttattggtttcaaagaacatatttatgtctgccttcatttcgttatgtacccagtagtcattcaggagcaggttgttcagtttccatgtagttgagtggttttgagggagtttcttaaccctgagttctagtttgattgcactgtggtctgagagacagtttgttataatttctgttcttttacatttgctgaggagtgctttacttccaactgtgtggtcagttttggaataagtgtgatgtggtactgagaagaatgtgtattctgttatttggggtggagagttctgtagatttctattaggtctgcttggtgcagagctgagactaattcctggatatccttgttaactttctgtctcgttgatctgtctaatgtggacagtggggtgttaaagtctcccattattattgtgtgagagtctaagtctctttgtagatctctaaggaattgctttatgaatctgggtgctcctgtattgggtgcatatatatttaggatagttagctcttgttgttgaattgatccctttaccattatgtaatgccttctttgtctcttttgatctttgttggtttcaagtctgctttatcagagactaggattgcaacccctgccttttttttgttttccatttgcttggtagatcttcctgaatcccttttttttgagcatatgtgtgtctctgcatgtgagatgggtctcctgaatacagcacactgacgggtcttgactatttatccaatttgccagtgtgtgtcttttaactggagcatttagcccatttacatttaaggttcatattgttatatgtgaatttgatcctgtcattatgacgttggctggttattttgctcattagttgatgcagtttcttcctagcattgatgtctttacaatttgtcatatttttgcagtggctggtactggttgttcctttccatgtttaacgcttccttcaggagctcttgtagggcaggcctggtggtgccaaaatctctcagcatttgcgtgtctgtaaagtattttatttctctttcacttatgaagcttagtttggctggatatgaaattctggtttgaaaattcttttctctaagaatgttgaatattggcccccaccctcttctggcttgtagagtttctgctgagagacctgctgttagtctgatgggcttccttttgtgggtaacccgacctttctttctggctgcccttaacattttttccttcatttcaaatttggtgaatctgacaattatgtgtcttggagttgctcttctcgaggagtaactttgtggcgttctctgtatttcctgaatctgaatgtttgcctgccttgctaggttggggaagttctcctggataatatcctgcagagtgttttccaacttggttccattctctccatcactttcaggtacaccaatcggatgtagatttggtcttttcacatagtccgatatttcttggaggctttattcatttctttttactcctttttctctaaacttctcttctcacttcactgcattcatttgatcttcaatcactgataccctttcttccagttgatcaaattggctactgacgcttgtgtattcatcacgtagttctcgtgccgtggttttcagctccatcaggtcatttaaggacttctctacactggttattctagttagccatttgtctaatcttttttcaaggtttttagcttctttgtgatgggtttgaacttcctcctttagctgggagaagtttgatcgtctgaagccttcttctctcaactcgtcaaagtcattctccgtccagctttgttccattgctggcgaggagctgcgttcctttggagtgggagaggtgctctgatttttagaattttcagcttttctgctctgttttttccccatctttgtgttttatctacctttggtctttgatgatggtgacatacagatggggttttggtgtcacatcctttctgtttgttagttttccttctaacagtcaggaccctcagctgcaggtctgttggagtttgctggaggtccactcgagaccctgtttgcctgggtatcagcagtggaggctgcagaacagcgaatattgctgaacagcagatgttgctgcttgatcgttcctctggaagcttcatctcagaggggtacccagctgtgtgaggtgtcagtctgcccctactgggggtgcttcccagttaggctactcgggggtcagggacccacttgaggaggcagtctgctcattctcagatctcaaactccgtgctgggagaaccactactctcttcaaagctgtcagacaaggacatttaagtctgcagaggtttctgctgccttttgttcggctatgccctgctcccagaggtggagtctacaggggcaggcaggcctccttgagctgcggtgggctccacccagtttgagcttcccagccgctttgtttacctactcaagcctcagcaatggtgggcactcctcccccagcctcgctgccaccttgcagttcgatctcagactgctgtgctagcaatgagcgaggctccatgggcatgggaccctcccagccaggcgcaggatataatctcttggtgttccatttgctaagaccattggaaaagtgcagtattagggtaggagtgacccaattttccaggtgccatctgtcaccccttcccttggctaggaaagggaattccctgaccccttacgcttcccgggtgaggtgatgcctcgccctgctttggctcatgctcagtgggctctacccactgtcctgcccccactgtctgacgagccccagtgagatgaacccggtacctcagttggaaatgcagaaatcacctgtcttctgtgttgctcacactgggagctgtaaactggagctgttcctattcggccatcttggaaccaccctttaaaggttgctgaattttatgtaatgaaaatatcattagaatatcagatgtaactcataatttagtactttttgtaagcatagcaaaaagtataaaataaatatcaatttatttgaatatttaaatttgtttctcctattgatattgttgatttgctcgtccacttgaaagaggcaggaatcatcactgtagtattcaaaccatgagtgttatagtggtttacaagaattaggaatgaaaggaaaagaaaatatgtacaaaacttagagaaaatggtaggagacatacccttggatggacaccatcttaatatttggaatgttactgtaatcctacaattcatttaaaaaatattttacatagatctcgtgcaagcttgaaagtaagaaaagtgcagattttttaaaaatttctattatcagaaagagttctttaagttaaaataagaacaaaaacacatggaaatatgaagtgaagaaatttggtaaaaatttagcatacataaaatctaggtaataatttgaacataacccattagattattgttaatttattttccaagataacattaaattactgcatctctgattactaagatttggttaatttattttttattttcatgctattttcaaagacatgaaaagaatctacaaattttagccattagtactatctttctatttaagagatgctaactgataacaaaataaggtctgattggcatatttctgcatattttacgtcatatttcagtaactgtgctaaagaatgatgcaatatcataaaagatagtagcaagattgaaaaaagctaaattatatcataaatcacaaatgagggtgagttgtcatttctataactactaagaaatatcccgatctggaaaagctaaagatttagctattgctaaagattttgggtaagaaaaatttactgtattgtcattgacctaatgaggatcactgattcattaaaaagtaagtaaacatctctggaacccagatttttatcaaccatgacctttggcctaaatttgtgaatgcattcaattcactatgttgcttttggcaagcgaagacacaatagctaaattctgacacgttatgcataaagagagcctttctttctttttcttttttgaccacatcttctaaacttaacaaagtctctctctatatgtagtcttatattatatatatataatataaagtctatatactatatataacatagtcttttatatagaatataaagtctatatattatgcatatgtaatttttttttttgagagagggtctcactcttgtcacccatgctagagtgcagtggtgtgatatcggctcactgcaacctccacctccctggctcaagcaatcctcccacctcagactccagagtagctgggaccacagacacacgccaccatgcctggctaatttttgtattttttgcagaaatgggctttcccagtgttgcccaagctagtctcaagctggactcgaactcctgagctcaagttatccacctgccttggcctcccaaacgctgggggattacaggcgtgagccactgtgcctggccccagatatatatttttaaatctcactccttcaaggaactttactcagtttacatattgcgaacatctgtccttggtggtattattctctgctttctccctcctatccttttcctgcataaatagtattgctcttcacatagtatgtagattagatactatctttttttaaggcagtttacttatttgagagaaagagacatgctatattcatataatatatctgatgtataaaactcataaataaggtttgccttactttaagacttagatttattgggggaaccagatatcctaatgactgtcaagttttaaattttatgattcctctctctgtcttaaattccaaatccacatttccctgaatctacttaactatatgattatgtctcacaagcagttcacactcaatgcatagctatatgtattatcttgcttcctatatacaagtgagtacaatcattataatacaactttctaaatgtctactttaacctattttacaaatctgaaaaatcataataataacacctatcttctaaatttgtgagaattatatgaactaatatgtgtacagtgctttgtagagaccagcgattttcagaattatttttattgccccctttagcaacgtgttcttggttactatatttatatttccttcctgtctctcaaatttttttccatctctcttcttcttcctgccacttccttggttatgttttctcatctacattatttcacaaaccacctaccttatcttttggcctgcaaaccagaccataccctgtatgctcagcgtatcctctacgctgcgggaagagtgacagcaagaaagttaaatgctgattttatcaccatgattcttcaaaatccctcaactctttgcaaaaataaaagataacacccattgtcggtaagcatgctagaaaatggcatctcacatgccatcataggcatgaaaattgacattttttcagaaagcgacttgcctctataccaaaccctttcaatagtacttcttgcttgacccagcagtgccacttacatgtataatcctgaactaaaggagaaaatgtgctctggatttctggcaaagcttcctttaagagcaaaaccctttttcaacaagtggtcatacgctaggagaaaaacaataggaaataataataataaaaaagagaactacctttactggtgccaagagtagaaaacaacaatcacataccataaaatcaaggaaatatcatccaaatctagggaaaatttaattatccagaaggcaccaagactgagaaaagaatgcatcattgtggaaaataagtggagaacattttggtgacagttgggagaagtatcgttggtcccagctgacttgggggacagtctcatttgctgcccatggcctcagatcagtatcactgcaaggctgttagaagcacggctgtggaataaagcatgtagtcaagccacacaattctttgctgacagaatttgaagtaggtttaattttcttctctatgttttccccattttcaaatttccaaagatgaaaaattaatttgacagcaaaaaaacaaaaaacaataaaaataatggtggcttcttaattccttattttaatgggcaaagttattccctctctgtttatactccagatattccacatgtgctaaaacatttagaaatcttctaaaatacgatatgttctttttcccttccatatctttgcaactactttcccctgcaaccgtctagggagttccttgtaattatatgtcactcaactgaaaatttaccttctttatgaaatattctgtgatgtctgtgtgcatgattacatatttccacttttgtgttcccactgtactctgtcagcatctaagttgtggtactcaccacaccagtaaatttctgtgtacatttctctctcctgtaccatgagagctctaggactgcaggaattgttattttaaactttgtatggaatttagtaaatgcttattgaatcaactcataagaaaattggatgctaatattttactttcttcagtttcctcattgggtttagtggagaaatttctcacaatattgcctgaaggacaagtttgagtacaggtacattattcttacatattttttctttttatatttgtcattatatgtccatttccagtgaataagtgtttaattacatttgttcattccatattcacattccatttactgttcagaatgtggagatcatgtttcttgtgtttgacttgcttcacacatgggagaagttgcatgcatgtgaattcacttaaattatttcacaaagcagaagggcacggtggctcatgcctgtaatcccagcactttgggaggctgaggtgggtggaacactggaggtcaggagtttgagaccagcctggccaacatggtaaaaccctgtctctactaaaaatacaaaaattagccagcatcgtggcacaggagctgcctgtagccccagctactcaggaggctgaaacaggagaatcgcttgaacccaggaggcagaggttgcagtgggctgagatcgtgccactgcactccagcctgggggacagagcaagaccatgtctcaaaaaaaaaaaaaaaaaaaattcacaaagtgatgactgcattttcattccatcaaaaataaaaattattagagttactaattgtattatttatcagatgtggaagcaaaaggattttcaattcactgtgcagaggaggtatgcttatagagactcaagaaaacaatctgattgttttaatttttctctaagctcgcctgccaaaaaaagaattctgatctggctcttagattttagtagattaaatttatggaaaacaggaatatggtcctatgcaaaatgttccggtaaaagtttttatgctgatattgagtgaattttaagcttatttagtctaaagtaaaacactaagttttttccagaacctcaactaaacccaaatatttggagaaaaaaaaggaagcaaaaacaaatgttcaattgtatgacagaagttaatttcaaaaatgaatgatgaaagatgttgacttttttctgttataacaacatataacatataatattatagcagtaatattataatgacataattgttttcatttcttttaacaaaatcattaaattggtcctttccacgctttactacaaactctttcaattgtcttccatttctttgacaagctagaagggtctagatgtttctcatgtggtgagccctgtcaaacacttttaagtttgcatttttttccagataaatgtaacaatacccataaatcacacttatttggattcttatctaatattgcattgcaataattggaaataaggcaaaagctttttggaaggtatgcaacactttactctcaaacctcagataaaatctaaaacctgtgtgagactaaactgaaaagaggaagagggaaagaaggaaacatattcaatggaggacactgtgctaaaatgtaattttacatttccattgaatcctattttatcaaaacctgcatttttagttttaattttgattcatagtgtgatttgggaatcattgaaatgacacatgttaaagattacaatacaaataacacaatttgcacttccagtttgcagaatttccgatttggcagtttgccagctctttgaatctaagagaaacagggaaacaaaatttctgcagaagtgttacttctttccaaaacatgatccagacattcatagaaccattgaattcgctattgctattctgactaccggagaaatacaacctttttgcgtgtgtgtgtgtgtgtgtgtatatgtgtgtgtgtcatgtgacatttggcattggggctggtggaggaagataaaacaaaactgcatgtcttgcctgtttttctgttgagtctgacatctgaggtgtaaattcaacaaaaattagacatctccttagataagatgactctaaataaatattctatttatagttctctgctgacataaatatagcttgcttaatcatgcacgtatcctggaatatgtgtaaagccaattttgctaaagtgattaatttgtagactgtgtattttttcttatgtgttccttgagtcaatgagttaaataatgggatatgctgtgggcatgtcacagtctgactcagtgactcatgtgctggcagtggccacgtaaatagagctactgtgtctgaaagcaatgggtagctagaaacctttttgacagctcatatgaaaacttaaagaatttcaaaacaggctgggtgtggtggctcatgcctgcaatcccagtactttgggaggctggggtgggaggatcatttgagcccagaatcttgagaccaccctgggcagcctcgcaagaccctatctctgcatgtaaaaacaacaacaaaaaattataatagtaataaaaaagaagttcaaaacgaaaaatatttgcaaggattttgtttctgggttttttgattttgttattagatttttaattaaaatagaataaaaacctgaacttcaaaatcaagatctgcttatttggaaattttgtctgttactcaagtctgtccttttaatttttcagaataaattaatattatctatttctagatctcctacattgcagtttcttccagattaataacagtatatttaaaaattatttttcaacagagcagtgtacctttgccaggctgtagtccgacatgataagataatggaatcgtatgttaagcagactatcatcttgattccaagaattcatctaggaaaattacttaacaattgatgattttgaattatttatcctgagagattttgccaaatcccaaagtaaaaatcattggaattactaatagtactagcaagcatatgtactacatagggtgctaggaaacctactagctttctagccttgttgactaggtttagaacctcacctctgccagttacaaactacaaactgtgtgaagttaggtctaagttctttaccttctttatcttcagttccttatttataaatagataaagtactaatcatacctataggattttttaagatcaaaaaacagaatgctatttttaaaattttccttacaccatacctagcataagtaaatcctcaatttatagtagtttctgctatatttttaagctcataaacaaaaggacatgttgcagttacacctattaatactagatggatcaataaaaacaggtattttagcaaatataaaacttcaataatgaaaatcatataatgactgaagagtgttagttttatgattttttttcttttcttttattttcttttttttttttttggagacagggtttcactctgttgcttaggctggaatgcagtggtgcaatcacagcagggtctcactgtgttgtccaggctggtcttgaactcctgggctcaagtgatcctcccaccttggcctcccaaagttctgggattacaggtgtcagtccctgtgcctggccagttttgttgtattattgttgtaaacattttggcaatactgggacaacttaatttatcaaaaatcaacaaaatgttttaagagctctgtattgtttttggctcaattaatttggcttaaaagcaaaagattgagttacctggatatgtttaattctaccataaacttatttcataaggatctgtggggaagctttgtaaatttttgtttccagttatctaacttcagagattatttttttaaaaggaaaatatcagaattttctatttttaataaagtagaacaagaattttttaaacgttttattttaccataatttcaagttttacagagagattatccgaatagaacaaatgatcctcattttattctttacctagattcacaaattattaacatttttgctctggttgctttatcatttactctcttaataaacattttttaacctttcgaacagtgtgtgtttcctaagaaaaacacattctcttgaataactagtaaaattaccagagtaaaaaaatatatataccatttatataataggaatacctcttccagagccaatattcaaatttagtccattatcccaacaatgtcctgtgttttttttcctggtctaaaatttaactcagtggtaagaattgtgcttaatcatcatgtccctggagtgtttttaatctagattaaatcctcagtcttttcccttataaccttggcagcttggagagtacctgttattttgtggaatgtcactcagtttgggtctgtctgatatttcctctgtttagaaccaggtcatgcatgtcagatagggaaacagacatgagactgtactcttctcagcacatcacatcagcaggcaacatgatgctggtctgtcccatgattggtgatgttagctacgattgattggctaagatggttctgctaggtttttccactgcaaattttttattttccccttagtaatttataattaatttgtggagagatactttgaagatacctaaatcttctttattccccaaactttgacctactcatttaagtactcattgataatttttgcttacatcaatttttattgtaatagttccaaaatggtgattttctaagtctaccatcccttctacatttattagctgacattccacttaaagggataagattcccccagtactaatttagtttttgttcatttatttagatttggatggattaattgattcttagagaactcaatgattaataatccatcaccaggattattatcaggactctttgagctatctcttcctggggttggctttaactcaattgtcccttatctttcttgtgcattttttcagaaccccttttctttgtgggaatgacttcagaagagcttcgaaagttagctatgctggaatttggtgcttatttttatacctatgggtaattttcacttgtaatatttttctgtcttctaattttgccaaaggtgagaattttgtgtggttttattcttgttgcttagaggttgtttgaggagatttgggttcaggcagctgttattcatatacctcagctgctcaggactcttggatgcaaagactttcaccatctggcttaacagttcctttaacgaggaggaatcgtcttgtttgtaaactaacgtgagaaactatatttcagtataatgtgaaaacttaacagcatgggttataagaaaataaaaatgaagaagagctatattctttgtgaaagtgatgaacaaatattagaaaaagagtcgtagccaggcgccgtggctgacgcctgtgatcccagcactttgggagcctgaggcaggtggatcacttgaggtcatgagtttgggaccaggctgggcaacgtggtaaaaccccgtctctactaaaaatataaaaatactggggcatggtggcatatgcctgtaatcccagctactcgggaggctgagacaggagaatcgcttgaacctgggaggcagagtttgcggtgagccaagattgtgccactgcactccagcctgggggacagagtgagactccgactcaaaaaaaaacaagtagtaaaaagagtaagaaagaagagaggagaaagaaacagacatggccgagtaacatagcagagcaaatatccatggaggaaaatgaacagtaagagattattgaaggcaggtcaaataaatgtaaacagtgagaaagtataatattaaattttaaaatttcaaaggccatgtaaatacatttatgtatcatttcaaatcataaggtaaatgtaacacatgaacaaatattatgggtgagctgtttataggttattcagaggaataaggttgcttttcatgtcctggttgtcacagagcagagggcaggagaatagttataggggatcagatgccaatgacatcagtagtctagtggaggcaggcaggcagagccagagtaaccatgaagatatgaaccccaaggaattctcagaaatgttgataagggtactagatttcccatagaacatgggatagagtttttgaattgtgggtttagaggaagcaggcacgagctgcatgtagtctacactgtgactgagagatggtcattgcgccatatatgtatgaacagtccaggcagggtcagagagcaactcaagtaggtggtatatagctgtcctacaggaaggtgttccctaggaggtcgttgtgcaaggtagatatctggatcaaccacactaaagaattaggagaaagtgggcaactggaaactgtgtcaggggtgactaagctctgcttctagtgtaagtccaacttatattttgaaaggatcgtgatgcaacataacattgtaagaatctactacagtattacttaagtttcagtttgtaggcatagttttgatcttgtcattcatcaaagacatttgtactcatgtgaatgttttgatttattaaacatgccttcctaattaagatagtccaactatgcagtaaatacttgaatcctactattcctctttgttttgcgagcattctcaaaatcaaattctttacctgttcctaagatttgtgcatttataaatgaccaaagtcctatggtgttttgggtgtataatcttcccctttgcagttttggttctgtaattggccttctggagaatacatttatatattcaacacatatctgtgaagtgcaggagtaatgcatggaaagaacatgtgagggatatatgtgtgatattttccatggagtggtcagaaaagctctcactgagagaatgggagttttgagttaaaaaaacgaataggaaagaagcaaggcaattagccatacacatatctgggaaaagagcatcctaggtagaggaaaattcatatgcaaaagccctgagtaatttaggaaaacattaaacaggccaatatgctttaagtaaaaagagtgacagagaaataataggacatgaagtttgaaagctaatggggaccggagcatgtaagggcttgtaggtgctggtaaggactttagcttatattcttcttgagacaggaagacatagaaatgttttaagtaggggagtggcatcatctcatttatatctctcaggatcatcattttggctactcttctgaggctagtgcgtttggaatggtggcgggaactggagaggcagtaaagcaggccaagctcaggattgtggagaacactgggaggttatcacaaaaattctataaaggtattgtggtgtcctgaaccagtatgatggcaaggaaggtgattagaagtgccagattctggatatatattgaaagtagaattcccatgtgggatgtaatagcaagagaggagtcaaaaattacttcaaattgactgaggagcttaaaaaaggatgaatttatttactgagaaggggaagactgtatgaggagctactttagtaggaattatccatttggatttggacataataggtttgagatgcctgctggataaggaaatgtcactgtggggtgtggtggctcgcacctgtaatcccagtgctctggaaggcctaggtgggaggattgcttgagcccagcagatcaagaccagcctaggcaacatagggagatcctgtctctacaaaaaatttaaaaattagctgagtctagtggcacatacctatggtcccatctactcaaagggaggcctaggtgggaggataacttgagcctgggagacagaggcttcagtgagccaagattgcaccactgcactccaacctgcatggcagaataagacctcatctcaaacagaaaaattggaaatgtcaagcaggaagttatgagtatatgagtttgcagttaaacatgctgatagtatttaaaggcaggagatagggatcccttagggagtgagcgtaggtaataaagagaaaagagttaaagacagtgcgtgagacactctaatatttaaagggtgaggagacaaaaaggagcatagtgatatcctgggatcctgggaagttgagagaagtttgatttggctaactctaattgcaccattgagcggaagcagggtggggttcatcatgaaagctggctttttcttgcagggtgacttcttcagatcaggatgcagcaacattttcaaacaggagaacatcctgataaaggtctaaactatgatcccatggacaagggaggctcagcaagtggttggagtttcaggatttccaggtacatgcagaacttgaaattcttcacatatctccatttcaattctccagtgcttattcactcctgaccagtgggctgcacgatgtgcaatcaagcatatggatggtgaatcagtctaattatttttgtccttgctccaatactaccagctatttgacctatgagaatttgcttaacttctttatgccttagtttcctaacccatgaaacatggaagacaatagtacttacttaatagggtgtttctgaatattaagtatgataatataaatatagcacttagtacagtgtcttgaatatagcattttctaagtgttagccaggactatcattctgagacttggtgaggctgggcattcaacagatggtgcaactggtgcagatggacaacttacagcatgaaactttggccacagcagccctgcagctgcctgaactaaataattattttgcatgattttagaaagtccctgggtttttaaatgtatttgacttaagccaagaatttagaattttgaactttttaataagttaatactttttctgttctaattatatttcacgacagagtatgtttatgatatttttcattatagaaataatataggtttgttgaaaaaaaatggccaccatagataaatgttagtaagaaagttaaaataaaatgaaagctctttaccttaaggtaacattaaaattgtggtgaattttctcttacacatctctgtatacatctacgaagctctgaggtcctgcgtctctccaggagtcccagaaagtccaggctccaatcaggtctcaaagttccctcctggtacaaaagcaactaagtgttgcattcattttccccgtcaagatcttggaagaatagaggccgtgtttgtactgtatcagctcctgaaactgccctgcttagaaaacagatggtaattgacttgtatttgagagaggcaggctgtagactcattcatgtctcccttttgcagtatccacattctctttaataagtgtctatataaaaagtgccaacagattaacctttctcacactccagtctttttattcacatcctttacacagcctgtgggctgggcaacatggtcacagaaagccttactctagaggatattttattctagaagacaatatatagcacagattttcttccttcatgaccatttatttatgactttttgttttaccatctcttgaaacatttacctctttgtgaatgactctgttcttttttagtataatgactttttttaacctaaagatatatatttctaaagatatatatgatacaatattttaacattatgtttctaagcaaagacatcctcatcaatagacttgacacacagtgtacagtcagacaatattatataaaacaatgtttggatgaataagaaattatgttttgtatatgcatgccaagtgaaagggcatgaaaggggtgcaccttctatgacttttgagtccgttttgtgcctgcactatttccatattttaaagtctctgtgtacaaatgtttttcaccctaaaagtggtttgtatgttataatgttatttttaagtgcagtttgtggtggaaaattgatgaataaaatggtgcaaaagaagagcatacctgtgtgcacctgtggccccagctattcaggagggtcacttgagcccatgaggttgaggctacagtgagcaatgttcccacccactcactccagcctgggcagtagaggaagaccctttcttaaaaaaaaaaaaaaaaaaaaaaaaaaaaagaacttaccttccaaagaataactgccttgagctctctctctttctccagtgactattttctacgttcagtctcctcattccttttcagtgaagacagtaaatcttcatggcacttaattttatgtgtaagctgtatttatttacttttaattgttgttcttaattatataaacttgttttctttgttcaattgatatagttttctatccactggaaattgagtattttggattggatgaaatgaatcataatttgatccatcaaaattaatggaaaaaatgtcatataatggcttttcatttagcaggaaagtttttagaaatgaagtaaaattatggggaaggatattaaatatatacggaagctaaagcaactccattttggatgggaggctaaagcagctccaccttggaaactaatctgccatgttggcttaactgattaactccaatatctggaaggcctctaaaatttccatttatctattgttccttgtgtaagagaaggtacttaactttaaatcctgtccttaggtcaaacaaccttgatgttatcacacttcaattggcctacaaattccatctgagccactaatttcactatggtgtgtaagccctggatcagagacataatggtgccaggatccgccatcttgtcttgccaccaccaaagacacagacatggcttctgttccttaagtccctattaaatgtttgtttctaagaaacaggatatgtcagcctctttcttaggcctctcagcttccttggacattggtgtaggtttgcacagacctgcctatcttgaaatggtctaggtgtacttatttagctgcttcatcactgtttcccatggacttctgattcctactggggactattcatgagactgtctacctgtagtctccaatagctagataataaatcctagattctccatatttttatttcttacaaacttcttcctattattaataactgtatttgttaggatttttgcttataagagtgaaacaaaatctgtcatagcaacattgggattttctggaattatataagggattcacagaattgaggacagactggaagaagaaatcaaagctacagggtcagtcagtcctggaaactacagtccaaagttgctggtgggtactaatactgccaccagatcattactagtgccattggatctgacttttgcatcattaattctaataatctctggtcattggctcatttggtccacatcaaaagtagtgggacagtctcattgactgaacttgggtcatgtgttttctgcctttggattctgtagtggaaggtggggctctgcatcccttctgcatagcccccatgggagattctcctgaaagataacaggggaattagtgttggaagtcctacaggaaacaaatatcctttattgttgccttcatcttataagtcataataaacctagttagtaaagaaataaatctcaaggagagtcattttcagggagaaaggagacgtgttaatgtagcaccatgtgctaaattaggaggaggcagttttgtaatagacatgttttttgtagagatatctgggtgagcttatttaacaggggctctaatgtataggcaatctttttttttttttttttttttttgagacagagtctcactctcactctgtcaccaagctggagtgcagtggcatgatcttggctcgctgcaacctctacctctagggttcaagtgattcttctgcctcagcctcccaagtagctgggactacaggttcacgccaccacacccagctagtttttgtatttttagtagagatggggtttcatcatgttggccaggatggtctcaatctcttgaccttgtgatccacccgcctcagcctcccaaataggcaactcttttaattgtcaaaggctaatgtgaggataccagaggaagtttaatattttaaagtgcatcacataagggccaaatcacatgacgatttattgtgtgaacacagtttggattatccatatgatattcatattgacagcactgatttcattttaggacaacagcatcatctgctatattaatgttgttaatacactttttgtgggttttgtttatcaatttactttggtctcatacttttatgagagctataagaatataggttttctatctatttctatgtttgtgcatacttaagtcagcacagtacatttgtgaatgttttttctttcaaaggaggtaacacattgctcattctatggaaacatgactcctagctttgattaatgcacagatactcatttttattccaaatgccattcatcaatatagttcttttgataccttttatccctgctactataaaaatagggattttttttttttgctttgttttgtagtgctctcatttggaggcagtttagctgaatggttaagaatttaagttttgagctgggcacagtggctcacacctgtaatcccagcaccttgggaggtggaggcagaaggattgcttgagcccaggagtttgagaccaccaagttttagtaacttattttattttattttattttttttgagatagagtcttactctgtcactcaggctggagtgcaatggcatgatcacaactcacggcagcctgggctcaagcgatcctccacctcagctccaaaagtagctgcaactacatgtgtgcataaccacacctggctaatttttgtattttttgtagaattggggtcctattttgttgctcaggctagtctctaactcctgggtttaagcaatattcccatcttggcctcccaaagtgctgggattacaggcatgagccaccacgcctggcctagtaacaaaatacgaaaattgttttgccagacaaaagtcatctttaacatttgcccttactacccacacacatacctgaaatggtttcctgtggctgctgggtgtgcaaaaagagactctaaggcctttaggcacatgaattcagagctcaatccttcgctggggaatgtagttagaatccacatggcttgaactccataatgggagcacactgggtcagccattaacatccaattcatgtaagctcatgactgaggttgccctttgaaacaacctgagagtcttaaaaaatgcaaatatctggggctcgtccccagagattctgatttaatttgtttgaaataagacctgggcaactattttttaaaactcctcaggtgtttttaaggttcagctttgaaaacctctgctttgcctagcttacttcaggacctcattcttatcaattgccctcctctacattgtaattaagccatctgtggaacagttctcctattagatagccaatgactatttcactagacatgttagacccttgatgaatgatgatcattcatttcaccttggacatacagcccaagaatgtgcattgccaataaacagcaactacaagcaaatgagttagttattgtaatgtaccccaaagtgatacttcactgatttctgagaaaaagaaaaatacaatttatttttggacagtgatgtgatacagaagatcgctatattaggatggtgagatatgagggaggctttgggtggttagagggtttattcaatcctatgattctgtgattctaggtatctgagatctaaaaagtaaagcagcaatggggttagaaaaaaagatttggacaatgaaaagaaggttgtgaaatcaaaagcctgagttcttatttctttctcgtcttccgttaggggccttgcgcaaataccacaatgaatttacctccaagcctcccattagacacaaagccacttttactcagaggtttagttctctcttccattccctggcagacaaatcctaaattgattcctctaaatcgatttcctctttctctttacattattaacattgctactaaaactttactgtactcatagattcaaatgggttcagattttccaaaacatttcttgccataatgaaggtgcagccaccagcacgaatttacttgtctcggtttgtggtggaaaaaagtgagaatggcaaactagcaagcttctacttcttctggcacatatcagccccctccattttacctgaatatctccttctctgacctacagcctttggacatttgcttaaattccaatgcatacctacatatgcagctgtttagtgcccacttccatctgggaagtagaagcctcgctcgttgcaacctctttcgccttcttcaccttctctagctgctctctcttctttgctcccagtgagagtgaatggttccaccatgaacccggggcctaaagccaggaagctgtgtggtatccgtactattttcttttaccatgatctccaatccatcactactatccctccgaagtatcctggaatctattcacttctctccatctctactatggaagcttttaagtatgccatcactatatctcatctgaattactgtgacagtctccttactgatctccttgccattagcttagttccctggagttgccatggagacattctttcctgtaaggacaatagggaatgtagcttgagagttttagaaatgacaagtgtagcatctcagtcatttttccagtgaacctgagaattagggaaaacttatttgttaccaaaatcatgacttcacacttattcctaggttgtaatgctttggaaaacataagttgttattattttgtcgttttgaggaagtttttattacatgtttttgatttgattctcatatactatagacattatctgatctattcttgcaatactcctaagtgattacaattaaccacaaacaattgtttctactttatgggtagggagattgatgcagagaaagtatttttatgtccagtcatgcaatagcttcaatcaataatcaatcaataatcaatcagaaataaagccaggtttctccaacttctgactttactatctcttgactatgactatataggctggctggtgaggggtaaagagtgaggggagataaccaaaaccttgattattagtggttatttaaattcacagcaggtaatgggaaaatataggaccacgagttagcaagaaagtttgattttcactggtggctctgctactcatttgttgagtgacctttcaataagtcacttcttagcctctctgggtttcatttcttccttttcaggtaagataggtatttggaccacatctgagatagttgacctgggctctatggaaccccccatcctgccaccagtctcatcgtccatggatggatttcaaggagttggcaaactaaacctgtaccacctgtggaacacatgcacttttctaagcaggaggttcagagacaatatcagaattttaaagaagtctgtgataaaaaattattgacaacaaacaaatgaataaaattagaatatactgcctaataaatacctaggatcaagtatttttaggattaaatgtggttatgtaacaagaaaagctccttgcccagtgtaatttccaagtatgaattgttatcaaatttcaaaacacatagcccccaagtcaaccttcagagagatgtaaataaatatgagaggtcaatccatgatgtctttgtatcagaatgcatttggaatcctgatacttttaaatctcttcatttgtctttagttcagattatatggctccattttttgtgtgtgtgagaactcctgaggaattgttgagtcattcattttgcagacatgtgggtactctaacttctcacaatgtgttaatgttttaaataaaaatgtacttaagagggcaaacagtgacattccaatatgtacagctcatatttttgtttgcaaacccaattaaacacatcatcttgaaatcgtgaaatcattccagaaactgtacatggctttcgaaaaaaaaaaaaaagattttggcagcaaataggggagtttccttggaatttctgaatgcttatattatgctcagtgggagtttgctgctggagcacttggaacttgtctgtgtttggaaagctggggaattcttatcattgtacacatgggaaaatatagcaattttttatttggaggatgcagtgaaatgaatggtggtccatctggtggtcagggaaatgttgaatgattcccaatttaacttttctgttcagccctagaatgcctttgatgcacattcccatgcaaatgtctttatacttctctttctaggcaacaacaacaatgccagtgattgttatctatgcaaagactgaagccactgctctaaggttgtgaaattctagacggtctgcaacatctctgtctccttcatttctattcttatcttataccacaatcaccatgtctaactcagtcttcacacaggcattttatagatacttcccttacactgaagagtaagaattatcttcttcatgcattcttgttcatacatacattttttttttcaggatagttttgtgcttatcagttaaacaacctgtaagtaaatatttcattttttctctctccttatgcatattctctatctcagtaaatttgtttaacacatatgctctacaaggcccttgatattaagaagagaaagatgatttaaaaagagcctttggctgggcatggtggctcacacctgtattcccagccctttgggaggctgagagaggaggattgcttgaaaccaggagttcaagattaacctggccaacatagtgagacccatctttaaagagaaaacaaaatttaaaagagcctttatcacttaggtgaatcacagttttgaagatgaaataggtgtgtggacaattatacttttttcttggcccttgtcaaaatggtaattaattaatctgtttttgtctctctcaccaggtactattggtatctattcaatgttattcctagcatctacacattgtggggcaaaacatgtacttgttgaataaattaatgaattatggctagggcaataatattctttttaatatatagcataactgtatttatttaagaatatattccaatatcaaagggaaaattccaacaatgcaaaaaccatgattccttttgcacggacctaatatgtaccgatgggttatacatgccaatcaagtaaaggattatcaagtaagtgtgattttttagtatggacattaagttgctgatcacagattttgacttcagtggtggagcgtctcatcgacatctaaggcaaactcaggaattcctagagctgagtcagcatttctgtcaagaattggctttgggtccattctggcaaaagaacacctgcagtattgaatccctaaaactttaccctaaaaacaggatcaggatgattcctaaatacttattttttatttttattttttccgtaagttattcgggtacaggtcgtattgagttacatgagtaagttctttagtggtgatttgtgagattttggtgcacccatcacccaagcagtatacactgcaccatatttgtagtcttttatccctcgaccccctcccactcttcccctaaagtccccaaagtccattgtatcattcttatgcctttgcgtaggacaacaatattctaatagaggcacattcaagcttcagtggaggcaactaggatcttcttaattcggcatagagacatcagaggtttcacaaaaaaagacaatgtctaagctgagacttataagaatcagtaggcgtcaaggaaaacaggtaagttgactacgtttctgttggatgcagcaaaatataaatacaggagctgttaggagatagagctgaaaagaacttttttcctgtaggttggcatttcctaaagtgtgttctgagaacagtggtcctatctgttgctcagagaaagtagttttccatggtacgctggtaaatgtttaacaactggcttccttgaaaaaataagtctaaaacttctcactttaggttgcagcctaaaacttcttaaaagaggtatggctcaagcagaaattttaaaagataaaataagattcagaatagccattctaatgggggaaaattacttttatccggaattgttaaaaaagaaaaaagaagataatagaaaaaagcaaaaggcggatcacttgaggtcaggagttcgaggccagcctggccaacatggtgaaaccccatttctactaaaaatgcaaaaattagccaggtgtagtggcaggcacctgtaatcccagatactcaggaggatgaggcagaagaattgcttgagcccgggaaacggaggttgcagtgaggactaaaaaattcctgatttgtaacatttgttgggaagaaatgctgagtagcacatcattctataatatttccatcacagttatacaggagatgtgcacagatacatagatattagtacatgtagtcacatgattaggaaatgataaatgttgagtatttattgctttagtttttaatataatttatccaattgtaaattttttataatttgtatgatggctgtttactggttttcctaattcacaaaactttaacatttgacttttataagctgataacagctggattcagcatatcacaggtcaagtatactcagggaacatggtttaatacagtatatttgttatatattaaagggcctgagaagtcttgaagcaaaaatacatgtcttagcttactggttgaacaacaaaacccatttttcgtatactaggtattaacaagtcacatagccagagcaccatggcatcatatattttggaggcatggtgactcagtattcaatgtgcttatctcttttctattactggaaatggtaatcaaatttacttttttctattatcttcttttttgttttttaccaattcctgataaaagtaatttacccccattagaatggctactctgaatcttattttgtcttttaaaatttctgcttgagccatacatcttttaagaagttttaggttgggtgcagtggctcatgcctgtaatcccagcactttggggaggccaaggcgggtgcatcacttgaggtcaggagttcaagatcaggctggccaacatggtgaaaccccatttctactaaaagtgcaaaaattagctgggctttagtggcaggcacctgtaatcccagatactcaggaggatgaggcagaaggattgcttgagcctgggaaatggaggttgcagtgagttgagatcacgccattgcactccagcctgggtggcagagtgagactccatctcaaaagaaaaaaagaagtttttctcattaccctgtatgagtctattttcatgctgctgataaagacatacccaagactgggaagaaaaagaggtttaattggacttacagttctacatggctggggaggcctcagaatcatggtgggaggtgaaaggcacttcttacatggtggcagcaagagaaaatgaggaagaagcaaaagcagaagcacctgataaacccatcagatctcgtgagacttatttagtatcatgagaatagcatgggaaagactgggcccaatgatttaattacctcccccgggtccctcccgcaacacctgggaattctgggagataaaattcaagttgagagttgggtggggacaaaccatattattccacccctggtccctcccaaatctcatgtcctcacatttcaaaaccaatcatgccttcccgaagtcccccaaagtcttaactcatttcagcattaactcaaaactccacagtccaaagtctcatctgagaaaaggtaagtaccttccacctatgagctcataaaatcaaatgcaagctagttatttcctagatacaatggggatataggtatttggtaaatatagccatcccaatgggagaaattggctgaaacaaaggggttacagggcccatggaagtttgaaatccagcagggtggtcaaatttttttactaggcagtgcaccagcagggattctgtgtggaggctctgaccccacgttttccttttgcactgtcctagcagaggttctccatgagaatcccaccccttcagcaaacttttgcctaggcatgcagccatttccatacatcttctgaaatctaggtggaggttcccaaacctcaattcttgacttctgtgcatccacagactcaacaccacatggaagctgccaaggcttggagcttctaccctctgaagccacagcctgagctgtacgttggctcctttcagccacggctggagcggcttggacacagggcactaagtccctagactgcacacagcatgaggaccctgggcccagtcctcgaaaccactttttccttctgggcctctgggcctgagatgggagggcctgccatgaagttctctgacatggcctggagacattttccccatggtcttggaaattaacattaggctccttgttacttatgcaaatttctacagctggcttgaatttctccccagaaaatttttttttttttaatcccacagtcagggtgcaaattttccaaacttttatgatctgcttcccttataaaacagaatgcctttaacagcacccaagtcacctcttgaatgttttgctgcttagaatttcttctaccagatacccaaagttccacagatctctagggcaggggtaaaaatgccaccagtctctttgctaaaacgtaacaagagtcacctttgctccagttcccaacaagttcctcatgtccatctgagaagacctcagcctggattttattgtccatatgtgtatcagcattttgggcaaagccattcaacaagtctctaggaagatcaaaactttcccatattttctcgtcttcttccaagcccttcaaactgttccaatctctgcctgttacccagttccaatgttgcttccacattttcaggtatcatttcagcatcgccccaccctactggtaccaatttactgtattagtccattttcacactgctgataaagacatacccgagactgggaagaaaaagaggtttaattggacttacagttccacatggctgtggaggcctcagaatcatggtgggaagcaaaaggcacttcttacatggcagtggcaagagaaaatgagggagaagcaaaagcacaaacctctgataaacccatcagatcttgtgagacttattcactatcatgagaatagcaggggaaagactggccctcatgattcaattacctccctctgggtccttctcacaacacatgggaattctgggagatataattcaagttgagatttggatagggacacagccaaactatatcaacggcaattttcttttccagtctaaatctttttcttgtaatttccactttccccacaattcattaatgttttcctatcacaccatttctaatctgatatatacagctgtaaacataatgtatttataacacagatttgtgtccatgcttgtctcacctctgctagagggtcactgtccaatagagtaggttctgtgcctttgatagtttcataatgtaacaatgcctgatacagagttccacaaagagtgtttattatattatatttatattatatataatatatattttatttatattatatataatatatattctatatatattataatattatatttccaggctaacaaatggatgattataaagaagagataacacagagcttcagaatattcaaggtttgtttttctagtttacacaagcttgttaatcagagctagaagcagatgtaatagaagatttttgcagcacctggaaaataattctgaatctatataatggttagctaaatcagaggtctggctgggacccttttatttgtcatttgaacctaggactctctgggagtgtgccaaaagaacacataaaagaacattttttctcctatttactctttaatctcatcttcctccttcctcttcttccctcctactcctcaccctcctccttttctttcatctccttgtcttcctcctctcctctccctccttctcttcttcctcttcttgctgtcctcctctccctcccacttctacttccatcactcttcctcctctttctcttcattaatagaatatgttttcaatttcgatcgtaccctacaaattgtagaaataaagtcactaactttggaaatgaaagctagaaataatgattagaaaataaatcccaggtattatcatattgtttgctgtggcactgtactccttaccaacagacttctttattcatttctttagaaattcgagaaacttgacaggtggccatgtagcttccactcacacttaaactcttagaagtgccaacaatcctctataatgcttaataatggtatagggtgataacccagcttgtttatgttagtatcattgtgtgttgaactatatctatgatacgtagaatgcatttaagaacttttcctcctgatattgtattatagaattacaatacttattttattattaagaaaatttacatattttattagcaatagaagaaatcatagaaactatgttattgaactgcatctataatattgaaaagaacaaaaatcttaaatgcacataactagcttgctgaaggcatgaggaagaaagcagctactcacatttactccttagaaccacgatacttctttgtaatataatttagtgttgttaaggaatagtcatttcttatttcctaaaagatttctgtggtttatacacctggcctttggagcctcatttctttatcacctcatgcttttaaaaaactttctccaaagttgcagggaagggacttccctggacctacatggtttactgaaaaatgagaggttaaattgacctcagggtgagtgaaggacagaaacctgacttgctccacagagaaaaactcctgagatttacaatgagatgtattctcagccctcacttcccttttctgtggtcattttttcctccaggcctaaacactttaagctgttccttctgtgtaaggaaatcaatttggccacctctttcataatcaagaattatagaatgaattactactcatggagaatttgccatttaaaaggtggtaacttgacatcccattcttaccgttgttaagcaagagtggaagactggtaaaattaatcacttcaactgccattgctctttcaaaatccaggctgtttccttgaatgcatcactgttaggaagaatgctaactgagtcccattcaacatgtacaactgtagccagattctgacaacaggggaaatatacttgcagcaagactgggcaaggtggccataggcgatagagcgagccttgaggtaaaggaattctgtttctcctaattgataaatcggtcctgatcatgaccccctgctggcaaaatatcgtaaacgccttttttcacacattggttaacaggcagcacaggacagtgattcttgagagaaagcgaacaaatcaggtgaggcctaaaatcatcttagcttcccacctggaggccctctcaaggttgattcacaggaaggggaatccaagcagaagtaatagtttcacagagtccactgaggagccagactcagaaaacacagagggtgaggattttcaatttatgtgggaaagcactcagtgaggacgtagctatgcagaaaaaagagctacagaaatttgcctaatggtcacctgaagtctgctgctgaattctaagctgtggattgatagggtgaaactgtggtcaggcaaagaactgctagggagctgataaatttccagaactcatatagcactaagaggctttacatttccaaataccaagagtagaaatacctcattaaaaagatcaataaaaacaacatacctgtaatcctagtacttcggagtccaaggcagtaggatcacttaagcttaggagtttgagaccatcctgggcaacagagcaaggtcttgtctctataaaaaattaaatatttagccaggtgtggtggtgcatgcctgtagtcttgctgctcaggaggctgagatgggaggattgcttgagtccggcagctcgaagctgcagtgagctgtgatcataccattgcactcaagactgggtgacagagagtgattccctgtctcaaaaaaaaaaaaaaaaaagagagagagagacagattgtcaatatcatatgatactgtttggctctttgtcttcacccaaatctcatgccgaattataatccccactgttggaggaggggcctggtggtgaggcaggaaaacagggtctggatgcagggaatataaggccaattcacacttcagctatgacaggaaatatcctctctgcagggcacaggccaagtaaataactttgtaactttacttcaccctctccatttacataaggtgtacctgaagtaaccagtggaatcctctagagggtaaactccccaaaatactgtaacggggcccttgagcccctatgcctgggctcactcccacaccatggagtgtactttgattttcaataaatcccttaatttcttccttgctttgtttgtgcattttgtccgattctttgttcaagactccaagaacctggatacgctccgtgggtgacagtgggagatgattgaatcatgggtgtggtttctaatggtctcgtgataaagttctcacgaggccattagagtactgtttcatgataaagttctcatgagagttggttgtttgaaagcgtgtagcacttcttccttcactctctctcttcctgccagccatgtgaagatatgcctgcttctcctttgccttcgtccatgattgtaagtttcctgaggtctctccagaagcaaaagcctgcacagcccacagaactagaactatcagccacttagacctctttcctttataaattacccagtctcaggtatgtcttttagcagtgcaagaacagactaatacatcagaaataaaggaaaagccatcagtctagatcctatcaacatttaaagaataacaagggaatatgaacaatgtgatgacaatacatttggtaactttgattaatggacatactccttgaatgacacagattaccagaataaacacaagaagtagcagaaagtctgaagagtagtctagaagttactccatcttgaggtggtactttaggttccccatccttcctggttttggctaaggtagcagagttgcttaccctgacaaagctcaacataaaggtcagagcagtttactgcatgtttcatgaaacatgaaacagagggtgtttagctgtgaaggcactaaggtagacagtgtaaaagcaataacgcaagcaaaacccctcctgagaaattcatcattgaagagtgaaaataagaaagtgaaacttgtgagggagaatggggaataccattcagtgagcataaaagtaggacagagcagttgcttggaatcagccattagggaagaattcacttgatatccaagagataattcataaaataaggctgaagaagaaacagataaagatgagattcttagtacaggtaaaaggtgttttgttttgttttttttttttaaatagcaggatatttccttttttggctaacaaaactgaaggagaagtggtaataagataaagttttcagattaggaaagaaagaagtcaacaaaacttctagttaagttggaattgagaacttatgtacctttttaaaaccaaagaatgatgaatctgtgcagaagaaacaagacaaataaaaagggagttaagtttccaggagtgggaaaatgattaggaaatatatgggggaaactatgaaagataagggttattttagtaggtttgtttatacagatccattttggtggatatcaacacccagtctcccattctcatgggaatttttatgacatggttttaggtagaaacatggagatcagagacccctttctgcatctgctgtttctcaagcacctttagctcaaaataaccgatatgcccacgctgcatattttgggtggcatgttctgaactcctgtggaatgactgaagtctttgttcaaggtctcataagcctataatcaaagtgtaggctgggcttagttattgtctggagattctggggaaaaacccatttacaagttcatccttgtttttggcagaattcagttccttgactgacagtcaaggatgcctgtcagtagctagaggtttcccacgttccttgacatatagtgcatatacacacacacacacacacacacacacacacatgtgtatatgtatatacatatgtgtatatatatacacatatgtgtgtgtatatatatagtgtgtatatatgtataaagtttatttatatatatatatatatatatatatatatatatatatataaactttaatgaggattgtgaacctgctgaaagcccttaggacattccaaagtccaaaggtccaaagtgagtcacttgagattatgtgtggctctgcttgcccaattaatgtacacatctgtagttgaagtatagctattctaatgtcatcatgctgaaggtaatctagttggtgtcttttgaataaataaatgatgtacattctctagtctctagagcaacttttggatgaccaagattgaatcctttgaaaaaggatgaccattttctcactttttttgttatgttgcatgtttttctaatacctgtcacagttagtcctgagaatattataggataaatactggtcttttgtatatgggctgtcccatctgcattgactttgtacttatgattcatactttcaggcaacatttacgccaactatgccaaagagcatgaagattttttttggcttattccctacctactgtcagcttatgtatttgcagttatacttccctatttctgttggcttgtaaaaatgtgtttcttcagtacaaaatttgttcatattgagttaaaatgccaatttgagttaaactgggtttcactgatcatcttgtgagtgcctagctgatctaaattatccttttttgcaatctagatggaagttgaggctgggtgcggtggctcaagcctgtaatcccagcactttgggtagatcacctgaggccaggagttcaagaccagtctgggcaacatggtgaaaccccatttctataaaaatacaaacattagctgggcatggtggtgcttgcttgtagtcctagctacttgggattctgaggcaggagaatcacttgaacctggaaggtggaggttgcagtgagcctagagcacactactgtactgcagcctggcagatggagtgagactctgtctaagaaaaaaaaaaaaagacgtaagtttaaagcatcaattataaaatcagtagcgtttactaatttaacaaaagtttacattccttgcttttgcatagattggttaaaaatgttgttaatttttcaactcatgtttaaaaagggatgaatttctgattttaatttaaaatgtctcatcattagatattttttagaatttaagttgtgtaactaatatttgtcactttgatttgccatgtatataattcaatcctctagatattacgcaaatgcatccaaaacttggtgataaagcactgctctccataaccaatatgttagccaaggccttgaattagtattgtttagaggtatctgtcctactgagacaactctaactgaaatgaaatgttttctggtgaacaactttccagacttaagtcatctgtgcactctgttcagctcatcacagtaatttaaaggacttggcattaggaaaatgattgtaaaacttcaaagtcatgtactaaaactttttctagcagccacattaatggcaatatctccatgagtgaacatttagtttatcccacctgccaaatatataaatgtttacatctttcaaaatggtagaatgtgtaggttaaataaattttaaaatcttcttcaccttgtagcaatatcactgacccagcactggggaggggtcactcttccaggtgaaagatgttcttgagctgtctctcactattccattgctcaggggtgggtctatttctgccgtttcctgggcttccatccctctggaccactaactggatcatgtcggtttcttagggatgtgggaagtttgtgggtgtgggtatgtggggaagtgagaggtagcaaaatctccagaagcaatctcattttgaaaaatgtatgcatttatcaaatatattaggctaaatatctctgaaatgtgtgacaagtttcaatttcccgagaaggacattgattctattccacagattttctctggaaacaataaatcaatcatcattttacatcatccgttctgtagaatattttgctctcatgttcttgttgataaacaagaaacattccactccacttaggtcagacaatacttggagaaatggaaatgtccatttccagcagggaatgtgttgatcaggagaagttgagcagacagagagctccaaggacttttcagtttctcagattcaggtctctatggcctacttttattactttgtctgaaatgcaaattctcagaatgccaggcacacccatattccagtgcaagaataaaaacaaaattgaaagccaactacagttgagctttttattgcctatctctttgatcttgtcctctctcgtctatccttctcactcccaattaactggaataatccgaaggctgtctgtatttagtgataaacaactataaaaaggaggtaattcatacaatgtagatacattcctaaatgaccagaaggcctctcttcttgctgaatgttctgaacagtatcaggtgttactgatacgttgtttctcagtggtatagctgacctttattaagagaaaaaaatgcagggatgaattctcaaatccagccgctgctgctgttgggcctgttttcttttctcacagaagattaagggtaggcttacttgagattctatgttctggcaagtcttgttgctgaacttggcaggagcattcaaatatctttattagatgccatgaatcaagttccattgcagaattcataacctttcaaatctggctgccttgttttgtcaacctcacaaaaaaggtgtggcttcaaataatgttcattttgtggtgtagtgatccagtgataaaggtaaatcttgttccatagcctatgcaggcaatcttcatttaaaacacatggatctgtgagtttgaaatgtctacagaagttccaaatatgatccacaagattttgccaaagaaaagagttgggctgaaaaagtactagctttttttgaaaaatgccaatattttctttgagcctgatgacagtccgttggcttttgttctttaaagatacaaatcgccatagttttagtgggaaattatgttactactttcttggagcaaagatttgaaattgctctctccaaatcgcttccaattccagaaatctggcctaaggggatccaaaatcttagagatgtacaagacttagcctgccattcaggcatggccccagctatcaagaaaagctatagacaatcaggaggttttgtaaataccagtgagaaaaaaacttaacttgtgtatggtataggcactcttgaacctgagttttgcttttgtagcagtactttagcctggaggcccttggaggtgaaagagtatattcaacaggcacattcagaaacccatctctctatggaggtgaaaggtattgaaagatagactatcagttccctgagattaataaagggaagatagcatcttcaaggatggttttggtgtgcactaacattctgtatgacaggcgacaggtgacagactagcataaaaattctggtccaaatctgaaaatcataaaattgcccaaataaatataatttaatggcatttttgtctatgcatgatgcaattgtggatatgaatgtattagacatctattgctttgtataaagtaaaactgttcttttgtgtttatgaaaatatccgtggtgagctgggggcattagctttatgtaaaaaatgttgtgtttggggtattgtatgtggttatttcatagagaataattctatgttagagtaaagacagaaaagcacttgctatttcagctcctatttctgattctgtgaaactttgataataggtccatggatgtagtggactaaatgatcaacgtgcattatgtctctttaagactcagattacctaggaatgcagtttttttcccagttgtgtaatagcagctgactgaacacacagattaaatcctattaccttcacagtggctatctattgcttttaattgttcagaggcactatgccagggtaaaaccctgtcattttgagaggtcacattcggaaatggaacaccttagttatgtatactagtgccatttacatgcttaacactccacctgtgttctcacagccactgtatgctgtaaacactctttgtttattaagtcttatgatgcaaacttaacagaatgactgagaaaacaacctgccattgtttttctccagttgccatccattaagaacattttgatttggaaatttatcctctccttcctatatatttaaagcctctgttaaaaatcaaatggaccttgagcaaacttttaaaggtctgggaggtgtttaattacttggtactgaaactctggcattttgtatttttttttttttttttttggtaattgctattatacctcctcctgtggtacagactccccttcgcagaaatccccataaattaaacttctttccattagtggagagatgaagaaaggacagccctgttttagtttcctccatagaataatgcatatttattttatatcgtgagaggctgttaggtttgggctctgcttccagaggtccagatggtttaataaaaaaagtagaatacatggcatattttctttttctcatcgagaaagaaacagctttatgtcaagttaatttgtaagttacaagttgaaggaaactgctatgtaaataaaaagactgataaaagagaagaaaacagggcaggtagaggcatcctgcccagaaaaaaaaaaaaaaaaaagcatataataaaaaatgacttcttttaaacaaagactgaaatgtttacatgatttacctcagtctgagtttatacatagctctagcccctgaagtaatctcagctccagtgtatttgcaaacagctagtgtcctaaattcttcactatgtaatacattaagaagaacatgttatgagttaaaaccaaaagaaaaaagaaacagtatgaataagcaagttaagactatgaaggcttgcccaagggcagatattcagcaacatccagacacatacagtttggagcgaacttgattaatgcttacacaaaacttgttaacctctaataattaaaactttcccttctgatggaaagttcagtacagtatttttagagccttttggattttatctcttaacagaagtatatacatgtagttcatagacttgctcttttgttttacaatatccacctttaaacaagaaagactgaaagaatagttgaggattttgcagcattatcttggctatatcaacaatttaacaataacaaactagttttttgagaaaaaaatggaatgaaaaaatattaaagatgggaattttggatggagactttaaaagtatagtatcatatactaaacactatatgggaaaccatatttaaatctagaatattgaaagaaattccattaaccctatgaaaaaaatgcttctttcctttgaataatagtcttttgttgggaacaccagacactggagaatacaagagaaaaagaggggtaaaagttgaaaaagctacctattgggtactatgctcactacctccatgacagattgatttatatttcaaacctcagcatcatgaaatatagctttgtaacaaacctccatgcatacccccaattctaaagtaaaagttgaaaagaaaaaaataataatcttttgtatgcagcaattcatacacatttattatattatcattgaacattctagtcacataatctttaaacatgaggaaatattctgacaatggaattgaaaagttcatgaatcattttcataacagtctatatatatttacacaaggaatagccaggatattcaaataatttcagctttggctaaagttgctagcaccatcaaagtagaatttcttgatccatttttggaagggatagggcagagtggggagcaaaggcttgggcaggctgggctgggacctgacaggtgttcatgcctggttggtgttttgagtacagcattggatctgttgggataattgctaacagagaactgataaaaataaaacaatacaaataaaaataagaataaaataaactttattgagtacttactaaactcagagattgttctaaatgcattatatattttttctttttaaaactcacagtaatcctataatagttactattagttttaatatcccaattttctttgtttttaatcagacttatacaaatacttacattgccatgaaattaagatactcaatcagagtttccaaattctggaggaatcagtcaggaagaaaaatacattatttgtaaatgtacattttggtttattaagatataatccactaaattgttgtgagtgatagattgcttcagagaaaggtgctcttcatttatctggaaaaatagaacgttaaaacatcaatagtgttccaaacaaaaccctgcaactatccctcatcaattcattcagttctatataattaattcttgttctgctcagacctgagttagactcttgggtctcatgaatccatctgtttcttgactagaattggggaaatcctgattcagtccagtgaaatttccatgttaaaaaaaattgaggaaattaattacttaaacagaaacccaactattcattgccaatagatctagcttcctgatcaagattttgataaggtctccccaaggtttttttgtttgtttgtttgtttttgtttttgttttttttggacagagtccctctctgttgtccaggctgcggtgcagtggcacgatcttggctcactgcaacctcctcctcccgggtttaagcaatcctcctgcctcatcctcttgagtagctgggactacaggcacccgccaccatgccaggctaatttttgtatctttttagtagaggtggggtttcaccaccatattggccaggctggtcttgaactcctgaccctgtgatccgcccacctcggcctcccaaagtgctgggattataggcataagccaccgcgcccggcctttcccaaggttttgataaagacttccttcttatctttatagggagaaacatacaaagacttggcaagctcagaggccatgtaggtaagtgaccagatctaaaggtagacccaaaggcagcagctcagacagttttcttgcattaataattacatagagccaagcaaggagctaattttaaaaatcaaaattagcttaatcataaaggaacagaactcacacccagagggaaagttacctttactggtgtgactttctgctattacttagaggcctttgcactttgtccctgaggtgggtaccttatgaactggccaatatctaacctagtagaatgaagtttagatgtattctgtgggaggggaggcttagatcctagtcttagatctactagtgagtcaagtagtttcagtatgtcatgggaatattgggtaatctattaacaatataagatatatatatataatatatataaagtatatatattttatatacattagtatatataatatatataaagtatatatattttatatacattagtatatataatatatataaagtatatatattttatatacattagtatatataataatatataaacaatataagctatataatttattaacaatgtaagcaatatatatagcttacattgttagctatatatagagagcttaccttgttaatagattacccaatatttgttttatatatatatattatgtatgtgtgtatatatatgtgtatatatatatttattttttattttttattttttttcgtatatatttttttttgagacagggtttcaatctgttacccaggctgtagtgcagtggcacaatcatggctcactgcagccttgaactcccaggctcaagcgatcatcattcctcagcctcccaagtgtctggaagtacaggcatgcaccatcatgcctggccaatttaaaaaaatttttgtagaagtgcagtctcactatgttgcctaggttggccttgaacccgtaggctcaaactatcttcctgccttggcctccaaagtgtcgggattacaggcatgagccagcgcacctggccaaagtatatatttcattcctcttacattttatattcaaaatcagaagcttgcacttgagctgcacatactatttatactttttttattttacatttagaagttgtctaccaatgtttgggagctagaaagctatgaataataaaacatggtagatcttttacatgcactcagtattttttcaatatacagtctcagggttttgtagttgtttttttcccccgtcttggaactataccagtatactgaaggttagaagtcatactgaagaatttgctcctttaagattttagcaaatataatattctaaagctgtcacttgggcaatcaaagcttctgtctttgaagtagagattttcagagagaaataaaaaataagatccggagtttgcctcatgccatttttaaaagttctttctggtaagtacttcacacactttgcagaaattggattcagatcctttggctataagaaggaagcataattatcaactggccacgggaccattataagaatgatgacttgtgtgtttaagctgactttctgaattttaatttttggcatcatacttacaaatgttttgttagagatcaataaacaaatgtaaattgatctttcttctgagactgggattttttgctacactctatttgatttagtaactctaagtttcttttctggattgtatgactagtttttatggtgggagtgcggatgtggagtggagagtgatgaggaaaattgactctgtagttccggtggctcaataaactttgatattccaccagatttagtccattttgccagaaccccagtggagaagaacaggcttctggtgactgagctaatctgaaacctagaagcctaaacagtataatttaaaatatattctgattaaataaaataaaagtaaaaggtcagaatttcaaacatagaaggatttgacattaatctactggtaaattggtactgtacttgaaatgaggcttgaatggtgctttttttttccccctgaaatcaaatcatagacatataaaacaggatttttcatttctaaaaactatgcaaagcattacattttcttaatattataactttacacacaaaagcattttctcaaaataaaatactagatcaataacaagtggtagttatacaccttcatttaatacctttctctctttctgtctcagacagaaagaaatgaaaacatttaaggcttttattctgtaggaggaaaacatctttcccaaagtgattttacaaagattttctttcaagctactccataaatatttggaaacctcccctaaatcaagtaatcttttatttgacatatcagaaaaaaggcagccaaagatgtagtagacagatagcagaatggaagggaaaagaatggccctattgctttaggagaagccaagtgtattaaataagagctaaaccagctttggttatgtctggatgcaattctagtacttaatcattgctttttttttgtttgtttccagtgagacaagtagacattttttacgaagctggtttgtttccagtttggatggaaagtgcagcataagtatcatgcaaatatcttgtacggactaatcgccaagaaaatcactgactcgcaggatacggtggagtgaggctgtagggaaagagagtagggaggcaagctgtaaggtttaaaatatggcatccattcgggttgtttgtagcaagcttctggcctaaaagctcttcttgtgctaggacatgttctgattactttgccaagtgttggtgtcagggttcatagtcatataaatacgcagtccaagctttaagacagaattcataaacactctctacacagtactggcatggggggaagtaagtgcggttagtttggggataatttttgtcactctactactctttcctcatctttacctgtccttatcatctgttccccactcagacctgcttcctctacaggtcgtcacacactagaaaactctttctttcaggactttccttgacctaataatacatatattccatttccttaaggttcttatctctgttgaagctaatctgataaactaatatctgctgagttgtttaataacaaataacttctaccttgcccatctaagaatataattttaaatattaacatcttgctaagctttatctcaaaagaatgactaagattgagtattttatataatagagcagctgattagtacagagaaaatattagactaagcaaccctgaaatgagttgctttttgggctattttttaaccagggctttcaaagttggcatcaaacacttataaaaagcagttgaatgagctactaaatatatgcaacattgaaagagtgcttggtcctaattaactcatagttttttccacttcgtatttttttcttaactttaaaatatttaattggcaaacaaaaattgtatatattcaaagtacatagtgtgatgatttgatacacctacacattttgtaatgattactgcaatcaaattaataaacacatccatcatcacccatagctaccttttgtgtgtgtgtgtgaatgtgtggtgaggttcacttaaaatatgctctcttatcaaatctcaaatatacaataaagtacagtaattaactatagtcaccatgctgtatgttagatccccagaacttgttcatcttataactgaaagtttgtcgttttgactaacatgtccacattttccccacactccagcctccggcaaccacccattctactctctgcttctgtgaattcaacttttgaagattccacatacaagtgagatcattcagtatttgcagtatttgtctttctgttcctagctaattccactaagcataatgtccttcaagttcatccatattgttgcaaaaggcaggatttccttttttaatgactgaataatactccattgtgtgtgtgtgtacattttctttacctttcaatgaacacttacattgtttatgtagctcgtctattgtgaataacattgcaatgaacacaggagtatagatatctcttccaaatactgattttatttcctttgtttacatacccagaagagagattgctggtacatgtggtagttctatttttaattttttgaggaacgtccatactgttttcaaaatggttgtatcaatttacagtcccattaacagtatacaagggttcccttttctccacgttcttgccaacacttgttatctcttgttttttctatgacaatcatgctaacagatgtgaggtgatatttcactatggttttgatttacatctccttagtgattggtgatgttgagcaccttttcatatacctgttggctatttgtatgtcttctttggaaaaatatctatttggatcctttgcccattttttaatcaggttatttgattttcgcttttgagttatgtgagttccttacatattttggttattaacctcttaccagatctgtgatttgtaaatatttcccccattctgtaggttgcctttgcatttgttgattgtttcctttgctgcgcagaagcttttttgtttgatgtagtctcaattgtttatttttgcttttgctgcctgtgctatggatgtcatatctaaaataccatttccaagactaacatcaaggagcttttccctacgttttcttctagttttgtggcttcaactcttccatttaaggctttagttaatttttgtatatggtgtaagacaagggtccaatttcattcttgaactcctgacctcatgaaccgcctgcctcagtctcccaaagtgctgggattacaagcatgagccaccgcacccgtcccagtttcattcttttatgtgtggatatccaattttcccaacaccactaactgaatgggctatacttttcccattgtgtattatggcacctttgtcaaatattagttgattatgtatgtgtgaatttccatctgatcttcttatagctatgaaatgctatagtgaatgaaaatatatgacagtaattagtttaaccttcactattttctagtgttcattccctggatgaatactacattacttttaaatgacaaaaactgtaatttcttttgcaccaacctgatagatacttaacatattagtagcaatacttttggttacaagtaacaaatccccaacttaaattagcataaaccataaactagagtttttggctcacatatctgaaaagtccaggtatgttttgatcaaggcagtctctcagtttcctgtgattctcttggctgttccctcctctctattctggtttccatcatattcacaaaatggttgccaatagtagggcaaccagggcaacaggttacttggttcacatccaagaagagagacagtgtcacattctataatcgttgaacaaaagtcttgagatttactctgattgggccaatcactgtggccaggaagaagacaaatgctgattgatctgggtttgggaaaaagcccttatggaaccagtatctgttttaagtgaggtaagataatatagcttgaagctgagatagagtcaattcttccaaagttcatggctacagtacaatggggaagggatatttctaaaggaaaatctgagtgcattttgtaaaggtgaaatacattctgagtatgtagtaaaatattattcatcaagtttctctacatggagtctattttttaacctctgaaaaatgtaaaggaaaacagaggttcagagttcattgtttgccaaattgataaactgtgtgtgactcatatctggtttggcaaagaaagttcctttctcctctgtagtaatcaaatcttcattcatttcatagaactggacatacatacttagccatgtgaaagattcaaagtactgtgtaattaaatggcacttctcactacgagtcctagggagaagttctgatatgcctcacataattaatttaaaagaagaaagaccaagatgatactcagtcatattgatttattttacccaattttttctaaggtttacaatgcccatcctgagactgaaggcagggcatggatacatttaaaaaaaaccagaattttgaggaaataacaaattatgtttaaggagttattatctacaaatcaatttatccttatcttcccttgtagattctattattatcatatcatttatcaatagctattattacctctcctgccactgacaacacagctcaagacatccctttacttaatatccattggatgtgaataaatgaattctgttatctgactgtttagctaacttttttcaccacctaattttaatttgatgtccttatgatattgacttcttcattacagtggttttcttttaaatccatgaagaaaaaagctaggagaaaaatctgtctttaatttgcttacttttaggtgattatgtttaactaaggacaactcaagttgcagaaagcatcagataactattttcttgcctggtggtgacagcctacagctgtcatgctccaatgcccaactttattgctaccagaggttctttatccaaatataacctgtttacctttctctggtgtctaaaattcttatctgtacgtttatctcttatttgctttagccttgtcccaacaagttgctttttagggtccttaatacagcttacagttagaaacatttccaggtacttaaatgcaaattaaatgattgtttcaagcttagaaagtgaaatggctggattttgctcttctggccctggctgtgggtctctcttcacctacatgctacaaagttcaacttttgaaaagggagaattggtgtggaactttacgtgctgtcccagaagggcagacgtgggtgagtcattgctgtgacaacatgtggatagaagagcagcccttgaagagaagggttagaaaggttaggagttgggaagagtccagtgactatgaaattttccttttttccagctgagaatcagaatattgtttcttcatcaacttaaattgaagcaaaataaatctaaccccatgagttttaattgctatgtactgaaaatctaagggattgtctggctgacacctttccctttattctcatacctgagaatcagaggacgtttcctataatctcttcctcctggcactgttgattggtccagagacaggcacaatccctgaaatgtatcaagaggagtccttagaacagttttagaaatggaaactcagaaatggaagtttctatcttttaatatgccaggaatgtacctataaagataggagtgctgggagcaattaggatcatgttttctaccctgagaatgagagaaggtaggagtcttcactagtctgatatttaagtcaaactagtcataaaatatattcaaggtccagtaaatgtcatttaaatctaataagaaacataaaaaagaaatatgaaatgcaattaggtggtgaaaaaagttagctaaaccctcagatagcagaattcatttattgaaatacaatgaaaatattaagtaaaggggtgtcttgagccctgttgtcagtagcaggagaggtatcaatctgcatgacccttctttcaggtctctcatccttgccccaaatcacacaagtcaataagcacttttaacatactgagattgtaatactatttccttcttcagttaaaaaaattgactttttggggaggtttagaattaaatatagaaatagttaagtatataaaatctatagtattaaggctctggtattaaaataagagcaatatgttcatatttggttatatactatttataatgtttaatatctatctatattagttgtctattgttataaaacaaattatcccaaaatgtattgacttaaagtaacaaaactttattatttcatagtttctgtgggttaggaataaaggaaaagatttgttggatgcctctgccttaatgtctcttcaaggctgcagtcaaggtgttggctggggctgctgtttcatctgaagactcaactgggaaaggatctgttgtcaagctcatttgtatggttgtaagtagaattcagtttctcatgagtggttggactgaatgcttcagtttctcactagttgtttgctgaaggcctcatttggtcctttgccacaagggccctcttagggcaacttactttattagatccagcaatcaagagaggatgaatggtcaccatagacagaagctaggttttttgttgttgttgtttttgttttttgtaaccttatcttggaagtgacattgtttctcatgcatcctattctctgggagggaggggggttacataggagtgtggataccaggagacaaggatcacgggtggatatattggaggccacataacatattggcttattagagaacctgacagttgagacctttgaatcccatttaaaattttaacttaaaatttgatttggacttgttatttgtattgaaaaacctaagagaattgttacaagattatagagagtattgggatgtttgagataactttagaattaccattgttatgaatttaatttgtctggtttattagagtgattcaagtaccttagaaagttttgcttatcaatttaggcaagtaaaaagtaaatcaaatacattaactttataagcgctgtctaaaatgtttaagtcaatcaaattaactaaattgtaagaagcctgattgcttagtgcattctgctatccaagttactcaaactttagtccaagaccaatttgagagtaaatgttaaattttactgactttataaatagaattatatgatgtatataaagttaagggcttaagataaactaaatttgagaactttttactttgacaaattgaatattaatttaagaaaatcccagtagtcatgatttgttcttaccatgtaaaaatatatctattacatataaaataattggatttttatgtgtctatatgtatgtataaatgtcctcagagaaaataaaatcttacattgacaaaagctagtcttcagagaggggaagaaagaagattcaaataaaccagaagaaaggaggagtgctaacacttctggagagcttagtttcagttgttctttcctttagtgacattcctattcttgagtcctgtaagacactttagtcattatgcttaaattgaagataattttttttacttgaaacaaacagccctaactcatctatatttttccttgaatctttgttgcagaattgtaaatttgtgaaatagcacaaagccaagttgaagacaatatcttccctaataacagtagtgcaatgacagccagccagaaaagttctccaccttggcagcaatgagactaagacttttatgcctgaattgctatcttttttttccaggtcagtaaatttcttcatatattaaagtggatttaatatctggtccttgactcatgtggatatggaaaagtaataataaatattaataataaataataatagtaaatatcaaaatgtgttgaaaagtgattctagtgcaaggttgaagctattagttacatttcaatgatctttccaagggagtttaaactcattcattttgtagtattggaataataatggtaactgtcttatatgattattacaggatttgaaatgccatgcctggcacagtatctggaacagaatatgccttcaataaatatgagtgatgctgctgatgtgttaaaaaattatttttagatggggtcttgctctgttgcccaggctggagtgcagtggcataattgtgactcactgcaacctagaactcccgggttcaagtgatcctcttgcctcagcctcctgagtagctgagactataggctcgtgccaccaaaccaggcttttttttttttcttaattttaggagagacaaggtcttgctctgttgcccatgctggtctagaactactgggcttaaacgatctttctgccttggcctcccaaagtgctgggattacaagcgtgagccaccatgctggaccctgatgtgtttcaaaactttgtgcataggatctaaaaacctatgagtcattctagagctcttcctcctttttcattgcttagttccaacctgacactaggttctatttccctaattgtgctcctgcctgtgtttacctctttagttccattgttactgcatttattaagacctctatcatctttcatatggaatgttgcaaaattcttccacttagttctccagactttcaggttcactcttacctgttttattctgaaccaaccccaaacataaatctgttcatctaacttcttgattaacatccatgaaaagttccccattgctaagacaaagtgccagcctcttagaatagcactcacgatgcttcatgcttgcttccagccccaagttctgtgctgaactcatagagaactattatcagagaactgattatagtttttttttaactaattatgcagggtctttctccctggaacatccctcctcccaaactcttaagaatctttcaaggctctgctcaaatgtctcctattttatgaagccttctccttccctgactcgctcaggcagagttctcattataactgcctattaactttatacataaatcaattacagtcattataacatgaaattttgtctttttcttccttacatattggttttccaaacacagttgtgagctccccgaaggcaggcacatagcttatttatttttggctttttaccctctagtattatgcttggaattgggtggcttttcaataaatgcatgtaaaattaaaggcagacctggtttgatacagtggctcacatctgtaatcccagtgctttgcgaggctaaggcaagaggatcacttgaggccagtagctcaaggccagcctgggcaagatagtgaggcccccctctctacaaacaatttttgaaaattagctagacatggtggagtgcacctgtagtgttagctcctcaggagtttaaagtggtgggataacttgagtccaggagtatgaggctgcaatgacctgttatcacaccactgaactccaagaccctgtctctgaaaaaaaaattaaaggtagatcagctgatactcttggaattcataatattccaaattaaaataataaattcactcagtaaagatcctactcaagaaatctaagaagattatgtaactttcccatcaatttctcttatactgggggaaaggcctattttagactataacaaagcactaaaataaagcaagtttgtgccattctttaagtagtgggacaagaaagaacagaaaagtatttcatttggtttttaaatttttcttttttttttattttttatttttattttttgagacagagtctcattctgtagcccaggctggagtagagtggcacaatctcgactcactgcaacctccgcctcccagtttcaagctattcttctgcctcagcctaccaagtagctgggattaaaggcgcccaccaccatgcctggctaatttttgtatttttagtagagacaggctttcaccatgttggccaggctggtcttgaactcctgacctcaggtaatccacctgcctcgggctcccaaagtgcttggattataggtgtgagccaccatgcccagccatttctttagttttttgcatgccaattaaaataccattgaagtaagatttgttatagataagctgaaatacaacggacttgattgactctaagttaaaagggagtttaaagaaggactcattttcccctttttaaactttttgtttctgtataaaggacaagaacaacaacagggagggattcagggaagtttatgattgagaattactatggggttgcctcgagcttttccctctactataaaatacttacagagtaaagagggagtacatgaaaaaagatacaagcgtttgccttaaagatctctataaaaaaaagtaatcatttaaaagagtaagttttagtggaaactgctatttctatccattctggctttctgctcatcaagctgtgtttttgtgtgtgtctgtctgtatatgtgaagaactctcaaattactgttattttccttcattttgttttgtttttccttcaagttttgaatattttacagcaataacagaaaacagaattgttcagagtccaacattcctcattagtcattcaccacaacttgtaatgagacggataaagacaatgggaagcagagatcaatcactactctgtgtgtgaaataatttcacactgtgtgtgaaataatttgtgatacagatgcaacccagtaatgctggggcctgactgggatgttttagaacacatacggaagtaatcgtccagagatgaaatcctgtgacagaaaggacagttttggattacaactgataaacccccaccaatacatggctcaaatcaaccaacaagtaatgagtattgctatggaccagtgagacagggaaaggcctgcttgtctgtcttaggtgctaaaattataatatgaaaagcttattcattctctaattgaatctgaatcaacaatgattataaatatctgtatgcagaaaattaaattcagaaatctataccttacatttttacactaggctaaatacaaaaaaacatatttatctgcaatttatccaaatctcttcgtagtatctttaccctaaaactcccaccactccccacacatctcctgatcttcactttcttccatttgcaggaattccaccctaaccatcctcctcactctcctacctgcttcaatatggggaagatttacagatgagtataaaatgggaataaagtaggcaaagccacggtggaatttaggaaagcttacaatttgataaggagtagcccagataaggcctgaatggtgaattgtggtctgattgcaaaggttctggctggagggctggatttcatacctctggaatcaggcatgtgttagatagattataccaacagtagtatttagggctaattgactagaacagaaactggagacttgagagtagttatgaaaaaaatcaaaatacattaatacacatgacattataagaacttggcttttggcagtgaaagtggaagtggatcagaaaagaaggaatgaaaaaagaaaaaagagatcctatgctagaaacatgtaactttccccctcaatctcataaatctcaaatgcagcatgttcaccccataaaatgctaggtatctgcttgtgttagtcccatacacttatactattctctcactgatgttatcatgacagttcagtggtcatcagctaaggacaataaaatttacttaagaagactaatgctgcaaacatcattcttgttagagaaacctccctacctccactctgacccacatgaacgggaagcatggaccaggacattaatgaactaacattttgccacaacatctagataacatgaacgttggatttatccaacgttaggtggctaccgtgaatcagaggctgcagggaggcacccaggcggcattaggttggggcaacagcagaaatagcaaactagggccatatggttctggaagcattcctaccaaaattcttcagatagtaaatggaatggagaaaccaaatgttagaaaaaattagaaagaaatcaaaatagggagagaataccataatgatcctttatgattaaggaaatattactatgagttgtatttactttgtgtaaactgaactgtgatgacattatatagcactgtagaatagaaacaaagtttaaggagctctcaaggtcattcggtccaacttctcacttttacagatatgttgtatatagaatctctaatatgtgactagctggcatcggcctcagtcatctcaatcacagcaattttttctgtcaatgaaaactacaaaggcatttcatttggagtatcttaattctgaaggtaccttcaactacatccctttcacctttactcattcatagttctgtttacaggaggcaactatctattctatttccttatgacaatttcaaatatttgtagttttgtgtgtttttctcctgttgtcgttacgataaaatccaaactccagactggcaaaagcctctaaaatgtgatacttagactcaaatacagtatcccagaaatcatctaatcaataaaagaatgaacatataaacttccatgtttgggaaatttatatttcttttaagacagcctagtgtgccttacccacttcattagacacttcattcatccattcagtaaatatttacttgatgcacaccgtattccacgcactgttttatatgctgtgattaggtaaagaacagaaacaagtaaggtctttgtttttatagagcttatgttatggtagagtagaaaaaaacataatgaagaaaaaaacgactaacataaattcagaggatcagtgctatgaagctgaaaacaaaataagggtggtgtgataacctagaatgggataactaactgattaatttagagtggaggacgtgggatgccatttgaaggacataatattagagtcaggctattcttggaaatatatggaaaagagccatctagacagagtgaagagtgagtgcaaagttcctaaagggcagatgcttggtacattcaaggtgcagagaagctagtgaagctagagtgaagtcaggaaggaggggggtgaaaataggtgaaatcagagatggagtatttgatcttatttgcaaccagaaaccactggagggtagtaaagaagagtgtgggacgatctgaccttcaatgtgatccttgatgcaactgctgttgactcttgatcaatgagggactggggcactgactccctgaggcaaggttgaaaatccacataacacttttgactcccggctaatttaactaccaatagcctactgttgaccaaaagccttcttgataacaaatagtcaacacatactttgtatattgtatgtattatacactgtattcttgcaataaagtaagttagagaaaagaaaatgttaagaaaatcctaaggaagagaaatatatttactattcattaagtggaagtggatcatcacaaggtcttcagcctcttcatcttcatgttgagtaggctgaggaggaggaggaagaggagggactggtcttgctgtctcaggggtggcagaggtggaagagatggaggaggtggaaggggagcaggagatgcaggcacacccagtgtaacttttattgaaaaaaatccctgtgtgagtgtgcccatgcagttcaaaccgttttcgttcaagggtcaaccgtatttgttttctattgggtctactcattatatactctttgctttatttcctcccttggactcatcaattaaatattattatttaactctcttctaaattaccttattagttttacattatttaccttctgtattacattaggctttcttgacctactaatatctaattttaattttaattagtgttttttttttttgacagtctcactttgttgcctaggctaaagtgcagtggtgcaatctccgctcactgcaacgtctgcctcccaggttcaagcaattctactgcctcagccacctcagtagctgggattacaggtgcatgccactgtgtccagctaatttatgtatttttagtagagacgaggtttcaccatgtcgatcaggctggtctcaaacttctgacctcaggtgatccacctaccttggcctcccagagtgctggaattacaggggtgagccactgtggttttttttaaccagatctttgaaaacacaaacaccttagaacactttaactctgtttgatctcacctgcctttcatgcttttttgtattttaattctacatatgttttaaatactagaagtcattattttcctgacttaatatagtaaatattcattttgatttcctcactccttttccattacccttcaaattaccctgaatttctcttccttcatctggaagattcttttcccctcctgaaaaattctttacttgtattcctttgaatctgaatctatttatgatgaattttctgattttcttttttcctggaaatgccattaacacaccctctttgattttataagatttttcttaactcaatatagaacttacattcagtttttatttgtttggaaccttaagatagttttcattgtgttctgatttatgtagtttctgctaagaaattagcgatcaattttatttttgcttcttgtatagacagtttgcctccccctgctccccttggcaggttttaagatttcttctggtcactggcttttacttctatttggtgtgctctttttcttcttcttgccatttgtattgcttcttgaatcagcagcttaaaatctgattacttttgaacatttgttgaatattagttacaaataatgcttctgctttaatttcctttttttttttttttttttggtaggtctctaattacacctatgttagactgttttgggttttttttgttgtttttttcagttttttgtttttttgagatggagtctcactttgtttcccaggctggagtgcagctgcacgatcgtggctcactacaacctccgcctcccaggttcaagcacttctccttcctcagcctttttttgtggagacagggtttcaccttgttggccgggctagtctcaaacttctgacctcagatgatccacctgccttggcctcctaaaatgctgggattacaggcgtgagccaccacgcccggcttgttagactgtttttaaagtccatatctctcttattctcttttctgtatttttccattcccctttctctttttgtttcaatctaaatattttctactggcctattttctattcggaaatcagagtcgcaaatcctctctcaagctgtgttgaatctcttattctattgttttcttaatttcaattttttttttcatttctaaaactgttcttcattgtttctagttttttggaaaaattcccaatcttttcttctaatttttgaacatatcaatcacaatgattttaaaatctgtttttgataattcctgtatcaatcccgtaggggctgtctttttttttttttcatttaattattatttttttcctgtctctttatgtgtctgctaattcttaattaaatgctagaaattgtatgaagaattgtatatgctctggcttataatttttcttcagagaggggttcattagctgatggtggataggtaaagtagtagcctgtcagctaaatctgattaagatgaagctcatttgagcctaggttttcatttttgtaaggcctgctctctatttctggtttgcctttttgtgtgtgtgtgaaatacagcctttttggagcctgaaatgaaacgctgggccatttctttgtattctacctacttgctgattcttgctaataatttattagaagttttaaaaacttttatacattgatagttttgttcccaatgtttacactgcattttcctttcactgcctgattgtactggatttcaccagtaagtatgatgattgcaatatgttttttggtggatgttctatatgagactaagaaatctcccttctattattagtttttaatacttttgttgttgtttttgaaaatgtatgttgaatcttatcaacatccaaaagctttttctacatatattgatatgatcatacaatttttcttctgtagtctgttaatatgataattttcactgattaaatttgagtgtgagaccaaattcaattactataactccacttgtttatgactttttcttatttttgatataaaagaacttctttttccaatttatttaggaattttatatttatgttcattatggcaaaagtgagattggcctatacctttttttttcctttgtaataatgccttttcagtttttgaaatcacagttataagttggcagtggtctctttctctgtactctgggagagccagagtaaatttggaattgtttcatctttaaatatttggtagaattcaccactgaaacaaccatctggacaaggaatgttctttatgagaaggtttttaattataaattaaataaattgatgagtttgcaatctctttagtagttatctgactaatccaatttttctgtttctccttgtgtcggttttggtaaattgtttacttctaggtatttgcttattttatataaataatcaaattgactcataaatttaataaaataattgaactttttttattgtctgtatgacccatttttattcttgaaattatttattcataattcacctttctttgctaatagtgtgagatgttttactctagtttcatctaattttgaccccatcaacagggtatttctgagcaaaataaaaaaaaagtaacagctgtagttaatagtcatttgataaattctaatctattggtattgatttcagtaagaaacaaatggcactctcaaactgggcaattttaagttaatttattaaaacaattatttataaagttatctgcaggactcagggaaatagcagaaatagcacaggaccctgggactagtaactgcagggaggtgttaccacttctggacccggaggagcaaaggggggaatgataactagaacacaatgtgagtagctgtgcaaatgactgcctgatagatgctgagataaccaaaccaggaatgaagtcaaggaaaaatatcttgatctcgcttttctctagatctcaagtctcttgagagcctcctactgattgaactaaatcaggtgctgaaaggcaaaggagttgccagtctttaacctggagctcaaagcaatgttaagagtgaatctagagggcaaatcaagctatccaatgtgttttggaaagccattttgttatatttcttagcagttgagaaactcatagactcctaagaatagtaaatcattttgcaagaaagttgccttccaaattttgctttcaaaaattggaaacagataccacctgataaatcactaaaaaaacttattttgaggacagattactatgtgtttttgcaatataatttagagggagctcaaagaactgagtagtactattacaacaaaactttcattttcatcggcttacttatgtgaacaatttttcttaaaacttattgctataatgagactagaattgatcctgatccttattttatcaataaataatatttatccttgactgtattatttgagggaaaagctccattcatattggtaagaatgcatttctgatacattttaatttctaatttaaaataatttttcataacaatgttaatattatagctatgcttctccctggaatattaccccagtggccaggaaactgcctgtgcctgctcctgggaaaccagagcatggacttgcctgacccagcccccacctggctttgcccctccacacaccctggtagtgtagcaccatggacagggtcctttgggctctccatggcctcacccattgcccaaggcactggaatacctcctttcggtaacataaggcaagcacaaatttcacagctaccgccactggtgctgttttgcatgtgccacgtcgtggctggaagccaactgcctccagtcttttacaacatctgcaggaacaatcacacagagccctggagaaagaaaacttttgtgtgacctcggccttcaccattgcctgcatcaccctcgctaaccagtaggtcttgagtctgtccacatgccctgtacattactactactgctgacatttgaaaaagccaacacactaaggctatttataactaaggaaatctcagagtctacgtcactgccctcctacctccatcagagctggtgctggtgcccgctgctgtgagactagaggacatgtcacatcactgaatctcttgcagacacttcctagtaccagcctgaagtgtggcagccccactgggtggctagacccagtagaacagcagcattcacagtagtctcgttctcagagactcctactcttagagggagggggagtgcaccacattaaggaacaccccatgggacaaaagaaacaagaccacaggccttgagtccctgaactttccacttgtgggaagtttctttcagcagaggcacaggtacagttctgggcttagtgaggaaagtctgtggctcttaacccaacagtcaggcagcccttgtactcatgaagcgtcgtggagatggagaaggggacctcttctccctctcatctaccattatagacacagctggggcaactcctacgggagcatggcatgggtagatctgtagacaccctttctggaacatttcaggaccattcctgaacatttctggaggattcttaaaggaatattctcaaaggaagagtgccatcgaggcttgtttgaaatgtagagtcacaacccctctctacatggagcatgagccttcctgcagatgaaaagaggtgcctgtctgatgtgaacagctggaacactgagttaggggtgtgatgggaaggtggatcacttttctgctggcctggaagcagagctgtggcagctccctatctacccttgaaaagacctcagtgcatctcactgataacttccccagccactgctgtaaaggctgggatctctgccgatactggggtttgtatttatccgcctgctttagccatagctggttttgacctgtgggcacctcaaactggccagaagcctgaattgttcaatccagtgaataaaaaatactagggaaaaaaaaatttcagtgcacatctctggggaatgagataagcttcataagacccctgtcattccagcccaacaggggacaacgaacctgctcacacacccagtacgtcattattgcagccagcatcgaagaaagccatcacgcaaagattctccataaccaaggaactcatacagagtcttcaccactgaaagcacttagagctgaagctaggtgacaataaactataaacattaaagtcacatcctcaaggggaaacaagagatataaaaaaccagtctaataaaaaaataaattcaagaataataataaatagtttacccaaataagaaggaaccaagaaaataattctggcaatataaataaatacagttctataacacccccaaaagatcacactaactctccagcagtagatccaaatcaaaatgaaatatttgaaatacatgacaaagaattaaaaaggttaattattaagttgttcaaggagatacaagagaaacaaacataaagaaattaaatcaacataaagaaattaaaaccaacttaaattttaaaagccaacataaaaaattttagaaaatcgggatataaatgaaaaattttctaaacagatacctattttaaagaaaatccaatcagaacttctggaaatgaaagacacatttaggaaactacaaaatgcagtggaaagtcctaacgatagaatagaccaactagaagaaagaatttcagagcctaaagacaaggcttttgaattaacccaatcagataaatataaaggagaaaagaattaaaagcaataatcaaagtctccaaaaaatatgggattatataaattggcaaaacctaagaaatataggtgctcctgaggctgaagaaaaagttaaaatttggaaaacttatttgagggaatgattgaggaaaatttctctggccttgctagaaatctagacatccaaatatgagaagcaattttttgtttttttttttgagacagagtcttgctctgtcacccagactggagtgcagtggcatgatctcactgcaacctctgcctcccgggttcaagtgattcttctgcctcagccttccgagtagctgggattatgggtgcccaccaccacatggcaaatttttgtatttttagtagagacagggtttcaccatgttggccaggctggtctcgaactcttgacctcaagtaatcctcccaccttggcctcccaaagtgctgggattatagggctgattcactgtgcctagcccagaagctcaatattaatgtcaaatgcaaatagtctaaatgatcaacttaaaagatacagattggtagaatggattcaaaaagggcatcaccaaggcatatagtcaccaggttatccaatcaatatggaggaaagaattttaagagtagtgagaccaaatatcaagtaacatataaaggaaaacttatcagaccaacagcagacttctcagcagaaaccttataagccattagggactggggtcctgacttcagtctccttaaacagaaaaaaactgtcagtcgagaattctgtatctagcaatactaagttgaataaataaaggagaaataaagtctttcttaaacaagcaaatgctgagtgaatttgtcaacgataaaccaattctacaataaatgctaaaaggggttccaaatcttgaaccaaaaggtgtatatacaccagaatggaaactcctgaaagcataacattcacggggcttataaaacaataacacaattacaaaatcaacacatggctggaagaatatttcacatctcaatattaatgtcaaatgcaaatgccctaaatgatacatttaaaaggtagattggcagaatcgacttaaaaaaatcaaagaccaaatatctgctatcttcaggagacacagctaacatataaggattcttatagactcaagataaagatgtggataaaagtatttcatgcaaatggagaccaaaagtgagtgggagcagctattattatatcagataaaacagactttaatgcaacaacagtaaaaaaagagaaagaagggcattataaattgatgaaaggatcaattcaacaagaagatataacaatcctaaatatatgtgtatctaatgctagagctcccagattcataaagcaattactagacctaagaaaggatatacagcaacacaatagtgggggactttaacactcaactgacagcactagacagatcatcaaggctgaaagtcaaaaaagaaacactggacttaaactatactctagaacaaatggacctagcagacatttacagaacactctacctaagaactacggaatatacattcttctcattagcacacagaacattctccaagatagaccatatgataggtcacaaaacaagtctcaataaattttaagaaataaaaatcataggccaggcacggtgactcacgcctgtaatcccagcactttggaaggccgaggtgggcggatcatgaggtcaggagttccagaccagcctggccaacacggcgagactctgtctctactaaaaattagctgggcatggtggtgggtgcctataatcccagctactcaggaggctgaggcaagagaatcacctgagcccgggaggcggaggttgcagtgagccaagatcacgccattgcaccactccagcctgggcgacagggtaagactccatctcaaaaaaaaaaaaaaaaaagaaaaagaaaaaaaaatcctatcaagtatcttctcagaccatagaggaataaaactagaaacgaattccaaaaggaacccttaaaactacaaatatacatggaaattaaacaatcaactcctgaatgatttttggcttaacaatgaaatcaagatggaaatttaaaattcttttgaaatgaatgataagagtgacataagttatcaaaacctccagaatacagcaaaagcagtaagaggaaagtttacagtgctaaacgcctacatcaaaaattattaaaagtcacaaattgacaacctaacatcctagctagaagaactagaaaaataagaacataccgaagccaaatctagtagaagaaaatgaataacttggggtcaggggtggtggctcacgtctgtaatcccagcactttgggagggcaaggtgggcggatgacttcagctcagcagtttgacaccagcctgggcaacatggggaaacctcatctctactaaaaatacaaaaattatttgggcatggcggtgtgtgcctgaagtccctgctacttgctggggctgaggtgggaggatcgcttgagccttggaggttgatggaggctgcagtaagctgagattgcaccactgcactccaatctggctcacagagcaagaccctgacagagtaaataaataaataaataaataagtaaataaataaataaataaaataaaagaaaagaaataacaaagattagagcagagctaaatgaaattgaaataaaacatatacaaaagataaatgaaacaaaaagctggttctttgaaaagataaaattgatagaccactggctagattaaccaagaaaagaagaggaaagggtcaaataagctcaattagaagtgaaaatggagacatttcaactgacaccacagaaatacaagatcattcgaaactacaatgaacacctaaatgcacacaaaacagaaaatctagagaaaatgaataaattcctagaatcatacaaccctcttagcttgaatcaggaagaaatagaaatcctgaacagaccaatcacaagcaataagattgaatcaggaataaaataaattgccaacaacaacaaaaagccgacagccagacagattcacaacaaaattttaccagacattcaaagaagaattggtactaatttcactgaaacgattccaaaagattaagaaggaatcctccctaactcattctacaaagccagtttcaccatgataacaaaacccaagaaaggccataataaaggaacgaaactccaggctaatttccctgatgaatatagatgcaaaaatccttaacaaaacacctgcaaatcaaatccaatagcatatcaaaacaaaaataattctccaccatcaggtggatttcattccatggttacagggatagttcaacatatgcaagtcaataaatgtgattcagctgggtgcagtggtgcacacctgtaatcccaccactctgggaatctgagtttgagaccagactgggcaacatagcaagaccttgtcactactactactactactactactactactactactattactcttactactactactactaaactagctgggtatggtggtgtgcacctctggtcctagctaccttggaagctgaggcaggaggatcttgagcccatgaggttgaggctgcagtgagctgtgatcatgccactgcactccagcctgggcaacagagtgagaccctgtcttaaaaaatgtgattcatcacataaacagaattaaaaacaaaaaccatatgatcatctcaacagatgcagaaaagtcattcaataaaatccagcatccccttgtgataaaaaccttcaacaatctaggcacagaaggaacatacctcaaaataataaaagtcatatatgacaaacccacgggcaacatcatactgaatagggaaaagttgaaagcatttcccttaaaagcaagaacaagacaaggatgcccactgtcaccacttctattaacatagtactggaagtcctagccagagcaatcagacaagagaaataagtaaagggcatccaaattggaaaagaggaaatcaaattatctctgtttgaaagtgatatgatttcacacctagaaatccctaaacactccttcaagactcctagatcgtataaatgaactcagtaaagtctcagtttccaaaatcaatatacactaatcaatagcactgcaatacatcaacaatgacaaagctaagaatcaaatgaagaactcaatcccttttaaaataactacaaaaaataaaatacctagaaatatacttaaccaaggaggtgaaagatttctacaaggagaactacagaactgtgctgaaagaaatcatagatggcacaaacaaacagaaatatacaccatgctcgtgcattagaagaaccaacattgtgaagatgaccatactgcccaaaacaatgtacagattcagtgcaattcctaccaagatcagttttcacagaattagaaaaaaaaatcctaaaattcatatgaaaccaaaaagagccaaatagccaaagcaatcctaagcaaaaagaataaatctggaggcatcacattacccaacttcagattatacaaggctatagtgagcaaaacagcatggtactggtaaaagatcaatggaacagaatagagaatccagaaataaagacaaaaacttacagccaactgaactttggcacagtgtacagaaacataaattggggaaaggatgccctattaaacaaatggtgctgggaaaatagaatagccacatgtagaagaatgaaatcggatccctatctttcaccatatacaaaaagtaactcaggatggattaaacacctatatttaacatctgaaacaaacaaacaaaaaattctacaagaaaatctagaagaaacgcctctggacattggcctgggcaaagaatttatgattaagaccccaaaaacaaatgcaacaaacacaaaaataaatacatggggtgtaagtaaactaaaaaacttctgcatagcaagaagaaatgatcagcataagcagatgacctacagaatgggagaaaatatctgcaagttatgcatctgacaaaggactaatatccagaatatacaagggactcaaacaaatcagccagaaaaaaacaaataatcctgtaaaaaagtgggcaaaggccacgaatagacatttttcaacagaagatatacaaatgtccacaaacatgaaaaaaatgctcagcatcactagtcatccaaggaaatgcaaattaaaactacaattagataccaccttacctcagccagagtggtcattaagaaaaagtcaaaaaaaacaatatatttccataagaaaatggaatgcttatacactgctggtgggaatataaattaatacaacctctatggaaaacagtatggagatttcttaaataactaaaaataaaactaccattcaatccagaaatcctactacttgggtatttacccaaaggaaaagaagtcactatatcaagaagacacctgcatgcatatgtttatcacagcacaattcacaattgagaagatatggaatctaatatatattatattatccactatatatatatatatatacacacatatatattatatatataatatctcccatggaatactactcagtcattaaaaagaatgaagtaatgtctttcgcagcaacttgaatggaattagaggccttattctaagtcaagtaactcaggaattgaaaaccagatacagcatgttctcacttataagtgggagctaagctgtgggtatacaaaggcatgcagaatgatataattgacattggagattcagaaagagggcaggatgggaagggcatttagtgtgaaaaactacctattgggtacaatgtgcactacttgggtgacagatacactaaaatcttagacttcaccactatacaattcatccacataaccaaaacccacttgtacccctaaagctattaaaatttaaacaatttaaaaaatgttaatatcattattattttgatcaattttatattaattattttaactgtcagatccacttagaccttatgaaaaacaaaattcaaaattcaatgtgtgtgtgtgtagtgtgtatacttgttgcagagagctataatcttaaaattcacagagaaatatttagaataaaattctgtagaggaagcaattatgatttaaatgataaaacaaaacaatacaaaatttctgactcttgagaaggaccatgttctcgaattttaaagtggttcataaaatggttatagtatttatcacccattggacatttttaaagccaatattgaaaatatacgaaagtaattactttgtcatgaatttaaacttatatatattatatttaaacttaaaaatatgagaggggtatggcagaaatagctagctctccaccagagataaatacttacctttccaaagggtagcgctgttgctggaaagtgggtttccaggcagaatttacatttcccagcactggagcccagccttgcacccaggtggggccgtttaagcagctctacaaagggtatctgcacccaggtggggccgtttaagcagctctacaaagggtatctgcacccaggtggggccgtttaagcagctctacaaagggtatcagaaaaggctgaagtgattaaggagcaggtgtgccttgtccgccctctgagtagatcccaaggctctgagtgatagtggagctataaaatgtaaaggacctgaatctttcaatcacccaccttggaatgctgcccactctacacctgcattgaattcttgcatctgagagtaataaatttttattttgttaagcccctgcgatttggggaattatctcctataataccgagcattaccttagctaatacagattgattccagaagtgaaatgccgccaagcaacaacaaacctaacgtatccggcattggcttcccaggtgagttgtgggcagtgaggctagaaaagtggaggaccctgttaagcaaagataaaacatttggcgagtatgttacctcccatgcctaccgagaccaattcctctgtgaaggggttcaaagatagaatgatgatggtatgttttggtgttctctgattacatctagcaaattatagaaccaagaggtgagctcaggctggaattggcttgtttgcaattaaaacttaaagaagagataatccaaaaatgtggagctttttgggttggaaaagtcaactgcttctagtctctaagcacagaaagataagactcagaaatgttttccgcatgaatgatccattaacccttagttatgacacaaattgcaagtgtgagttctatccaagtctgcttttctcagtgtactcccattacgttgaaagaagagaggaataacgagtgggtagggtgcaaaataaaatatcaggcttgaaaattatgactattaatgacttgtgactttaaaaatatttcagtgttttaaagcaaatgaaattcactagaagtaaacagatcagagcctactaattttttaatacgatgcagagctgaagaaatcccaagtcagaatttaaaagcttttaactaggcccggtgcggtggctcacgcctgtaatcccagcactttgggaggccgaggcgggcggatcacaaggtcaggagatgaagaccatcctggctaacacggtgaaaccccgtctctactaaaaataaaagaaaattagcccggcgtggtggcgggcgcctgtagtcccacctactcgggaggctgaggcaggagaatggtgtgagcccggaaggcggagcttgcagtgagccgagatcgcgccactgcactccagcctgggcgcagagcgagactccgtctcaaaaaataaataaataaataaataaataaataaataaataaataaataaataatacaaaaattagctgggcctggtggtgcgtgcctgtaatcccagcaacttgggaggctgaggcaggagaatagcttgagcctgggaggcagaggttgcagggatcagaaatcgcgccattgcactccatcctgggctacggaatgtgactccgtctcaaaataataataataaaaaaagcttttaactgtttaagacttaagccttgggtttcaaagcaacttgcaatgataggacacagtatgtgtaaactccacaacttcccagaagatttggcaccaaaagatggagggtaagagacaaagaaaaaattcactaagttagagagagaggctcctgggcaccatggtaaaatcacgaatcccaaactgaagatttcaatatcagcaaggaaattccccactgccacggaagagagacctcataatgcctacaaggtaggactgtctcattgctattgaccacagactggtatgtatcccattcttttcttttccaaatgaggtattttattgcagtttttctcttctcgctcatcattagagtgtccgtgtttgtgtgtgtggacacacatagcagataagagagattgccttttaagttcataggtcactagatcatgagaagccacgtgcatcctgacagggaggactgtgcatgtgttggtgattctaaatctaaattgaggatagtaactacataggattttgggatgttaccgttgagtaggagtaaaatgtattcagtgtgaggagcaagggatttatagggatattaagtgtggcaaagacaaatgatttgtcaatcaaaaactcagcctccctgtagtgtgtagagttgtttctgggaggcatcacccacagtttctacatttcccagtatcccttgcatttagatagggccatgggactagtctcaccagaggactacgagtaaaaataatgcatgttacttccaggctgaaatgttcaagaagcaggtatgcctgccccattctttcttcttcagttcactggctggaagtaaatgattcgaaagctatagacaggggagctacaaggtagaaggatcctgaacaacctcatgaaaagctgctcactgaatacagcactacattcttgtgtgtgtaaaggaaaaaaaaactattgtgttaagccatgaatttcaggggtttatctgaattctctgctactcttactcaatgattacaaagaatacatagttataaaaattactttgtgggtataggagcaaaacatttgaaagccattgatctagttcagttctacacacacacacacaccacacacgaatttaggggcaaataaaaatttatgtaaatgtatacattaaattttaaataatggtatatcattagcatgaaattagggcaacctaaatgcaggaatttaccagtttatcctctttcgatttaaatctagcagattgagcttaaaaatgtagtaggatctaacaagacagtcaacatgttttatttatttattcgtttatttatttttgagacagggtctcactctgtcactcaggctggtgtgcagtggcgtgatctcagctcactgcagcctctgcctcccacgttcaagagatcctcccacttcagcctccaggtagctgggactacagtcacgcaccaccatgaccggctaatttttctgtattttttggtagagatggggtttcactatgttggccaggctggcctcaaactcctgatctcaagtgatcttcctgcctcggcctcccaaagtgctgggattacaggcgtgagacactgcgcccggcccaacatgttttagtagccttgtttccttcatagcacttgtaagtgagaatgagacagtgttttttttaacacatacttaagtcacggtagtaagacaaatgattttaaggattagtgataggaattagtaataaatccatacatctggaaagcaaaatgcataggctagttacatgcaaatgactacatgaccattagctactgtgggaatagaccccagaaacatcacaccattgaataactatggagttagagtgatatctttactcacgattcttaaaaacaagctttaggctaggcaccgtggctcatgcctgtaatcccagcactttgggaggccaaggtgggtggatcacctgaggtcaggagttcaagaccagcctggccaacatagtgaaaccccatctctactaaaaatacaaaaaaattagccaggtgtgatggtgggtgcctgttatcccagctacttggcaggctgaggcaggagaatcgcttgaacccaggaggcggaggcggaggttacagtgatcacaaaggccaagatcacaccattgcactccagcctggtcaacaagagtaaaactccctctgaaaacaaaagaaaacgaaaactaaaacaagctttagaagggagtaagtggcaagtcgaaatccttattgtagcagggaaaaatgtaaaatgtatgtcatctgcctgtttgttctcaaatccacagccttcccttgtgctgctctgctgtgtaacacaaagggctggccctgaaaatgacgtttttcgtaactcccttcctggctgagagatacttaataggatattgcagggggagatttcagggtatttcctccccctccactctcttggggtggcatctctgacagtggctgtctcctccagaattccacctcccacctgacagcccctgctctgtagccccagctttgattggcagcctcccattggttccttggcactggtagtaccctgaattgcaccagttcttgaagtgatagagccttcctgctgttgctgggttgcctcattacccatgtttggctctttagctcttccaggatctttgtaactattaatagttccccatattacatttcttcaggactcaaatgctgttttccatattggacctaataactgatacatgtctgccctaacatctacatagaatataatatacttaaacatgtatatataaatttaccaacaacacaatttctcaataattatttgtgtttgttttgttgtttgttttgagacaatcttgctttgttacccagggtggagtgcagtggtgtgatttcggctccctgcagcctccacctcccgggttgaagcaattctcctgcctcagcctcctgaaaagctgggattacaggcacctgccaccacatgcagctaatttccgtatgtgtttgtttgtttgttttttagtagagacaaggtttcaccatgttgggcagactggtctcgaacttcttgcctcaagtgatccacttgcctcagcctcccaaagcactgggattacaggcagaagccaccgcagccagccaattgttatttgttgaatgagtgaatgttatgtgtggaaatattacttgaaaactgtggggaaaagagtttcatagttcaaagataaccttagaaatcttgtaaaatttaatgtaattgtcaggcctctgagcccaggccaggccatcgcatcccctgtgacttgcacgtatacatccagatggcctgaagtaactgaagatccacaaaagaagtaaaaccagccttaactgatgacattccaccattgtgatttgttcctgccccaccctaactgatcaatgtacttcgtaatctcccccacccttaagaaggttctttgtaattctccccacccttgagaatgtactttgtgagatccacccctgcccaccagagaacaaccccctttgactgtaattttccattaccttcccaaatcctataaaacggccccacccctatctcccttcgctgactctcttttcggattcagcccacctgcaccgaggtgaaataaacagccatgttgctcacacaaagcctgtttggtggtctcttcacacggacgcgcatgaaagtaattatatgctgacaatgagattttagtaagaagaattagaaatggtactaataccaaggcaggaggatttttaaaaatacacaaaaactagccaggcatggtggcgcatgcctgtgatcctagctacttgggaggctgcggccagaggatcacttgagctcaggaagttgagactgcagtgagccgcatcatgccactgcactccagcctgagtgacaaagtgagactttgtctcagaaaaaaagaaggaaagaaggaaggaagggagggagggagggagggagggagggaaggaaggaagggaaggaaggaatgaagggaaatgaaagacagaaatgaaagagagaaaggaaagaaagaaaagaaaaggaaagaaaggaggaaagaaagaaaagaaaaggaaagaaagaaggaagggaggctaataagcttgaatgtaatggtagaattaaggtggtcatatattcagaatctcaaaaacaaagcaagtctagaggcaatgattgcagttttgcagtcaatattaaatcaagtagcttttgaacctttttcactgtgtttcacaatgagaaatatattttatatcaagaatgagtacaatcatatatgcatgagatgcctcctgtattttccattcattgtctcctcttttatcatatcctatccagagtgattcagtttttcacacactttgaaaacatggatctaggcatgttataggaaccaagatagtatgcaaacttatccaaaggattaagacataactcatcttttatcactctgtctttctctacatacagtggctattgtttctgtcacctcagcatgcattcacctactttctggtaatgacagcataattttccttttggaaattttccttctccttgttttagtccataggactcatgtcaatgccctgcccacctctcctgtctccctcccaccccataattctgccagctctggggaggcatgccatctccttctgggcaggcagagtagctatctctctgaccacaaggactgtctcagtagtgggcatataacctaggcaaggccaaatcagttcttgttttggtggactgcaagctgctgggaatcaggcctgtagatccgggaagtgatcatgtgaaagagctgcctagaagggacgctaacaagagaaaaggagatggagaccttatggcagcaactgtgaccctggatccaatcaccttttcctatgcaccagtaaatttcccttttgaaattctaatttaagaaaaaccatctgatgatgtttagtatgtgaaataccttgaatttttttcaaaatttgcattctcagatctcttcagtatgctaaatttatagagagcaaaagtaaggagaaattgtcatataatcacttgaatgttaaatgatattacaagtgtctaaattcatttttacatgagaaaataaaatttgtaggacatttcaatgcattatcaagtcttgatctttttctcaatgtctacgtatttctagtgttgctgttctgagaagtaccaacttcattttactaagaaaaacacattggaaaaatatatataccatttacattaggatattcactgaaaaatacaagaaaccaaggtccccctcccctaacttcagtttaattattttctcaatcagtatacaccagagatgccatataaccatatgaatttatttagagctacctatagaaggtaagatttaaagtaagtttttaacttatgtaactcacatttttcaattctacttgatatttgattttaaatgtctacataatttattgatttgaaaaaattaattcaaagcagaatgtatattgaaggctactagtccaaaaaattgtccataaatgaaaaggttatactatttacacgacagaggaaaaatacagaagataagtgatactgggcaaaccgacatcatttactgattagtcactgccagaacatacaaacaagcttatgcctgattacagtttatctctatcagatgttcattgatgttcactactttgtctttaatacattatatgaaaatctagaccagagttattaatattcaaattactccttaaaagtgaaggcaattgttttctatagcagaattaaaatagggcaagatatgacaacattccagtacttctaggaaatccatatcaatctcacatggaaagatttggcttcaagctgggaggtctggagttagcagacaggatgagtcacttatacgatatttttttgagaaaacgactgatttggaaatcttgtgctttcactgttactagtgttaattactgcttgcaaagagttttacccaaagcaggtgtatttaatgattcttaagatagctgacaacaaaaaaagcaaaacctcacagctatttttatgtctgtgttgttatgagtttcagcatgggtacaaaaacatttacagttgtggctgtggcaaaattggttttatttccttgatagctatacatagaagactaagtaatttatggagatcagaataaaaaagttttattgaagggtaggcacttttgaaatttggacaagtcaataaagaagtaatttgaaaaaaatattacatttgcatttttttcttgttgagcatcttaaatataatatttttggagtactaactattctttattgctgtaactgttaaaagtttaattcctgagatttttggagtcggtaaaagttcttaaagtgagcagaggaaagaaatgtctttcccagataggaggctgaactgtgaatcaacagtgtcaatcagttactttctgtcatttttccatacagcagttttcatctgggatatgtttacactgtagtttattccttgactgcccccaaaatatactactctaagaagctcttggaagaactgaaatgttcagttgaaagatggtatataagtaaaaattattattgtgaaatatttgtcattgttaagtagctttcctcttttaaagtatgaacttgtatgtgagtgttttacatctggtttgatttaaataacaattcaagtatctcctttaaaatgatgttctgaagaacattaatatttatgaagcacagatataaatacactttctgaaaggcagaatattgaatattccttgaaaatcatttgttttgatcattttttagactatcaagattacaacctagcctttggtccacatcacatttttaatagttcataactttttatccatatacttaactaaaaatttagaaaacgtttatcaccaagtgcatgaaggaaaacttcaaactgtaacatttcatttaaaagctatattcaaatgaagataggatctgaatataagctatttgtgcttattttcagctatggctaacacataagctgttcattgggtttttgcttgaaatggagttgtatcatagtcttgaaaatgaattcccttagaagttgtgatcttcataatagcaccatttaaagcatcatcttcaatgagtgttatcaatccattggcaatcaatggtgggctaaaaataaagaaaacagtattttgaaacgaaagaatgaggcatattaccacttcattttaagttattttctgaagaatctattaagttgaacatgttatagggaaatgtgtgtcattaaactattgctacttccaatttttatttaattccatattagatatctagattagatatcttatttatctaatttattcaattagatttctttcaattggatattaactaaattatttgataaatttagctgtaaccttccatcattttggcaggaggaatttatactcattattttcactgagcaaatgatcattttctcatctttatcgtatcagtagatcttagacttaccagatatagatgttattagtgtagaaatatgattggtaacagctagcatttactgaaaattttattttttaccagttaccattttaagtaccttgtatgtatcattttatttaagtttttcaaagtccctaagtctgttgtattatctctattttatatgtgagaaaattgaagcatctagaggtatgatgggtaagttcatggttagtggtagagccaagatttgatctcaggtctgattccttcaacatgataactatgattcatgaaatcctcagttgcttgaattcagacataattcactgagaaagtatgtgtccatgtatgtgtgtgtatcaactatttcttataaaagtggttgaagtcatggaaacttgcaatatttcacagactatatttgaatattgcttggaatttaggcagagaaggtatcattgccttcaaaggtgactaaatatcaactttatgactgatggtagtaatgaagcattttacatatttcaaagtaacattcataatgtataaacttacattctatttataaacccagaaaaatatattttctcccagagagtttgccaaaccaaaagtttgaagcttgtgttcatttctcaactgtataagcttatttcttccctttttatagcttatctaaataatgctttgcttcatcatttaaaagaaaatagacatagttttacttactccaaaattccatagtatttaatcatatccttgatatgatccttatattctatatattgtcccatgttttcttctttttcaattgattcaaggatggctgtgttaacaaagcctggacaaatggcattcagtctcacaccactgttcataagattagcagccaactgccaattagaaggttgtaggtttcagcagtttcataaacatatagcacaggacaaactgatcattaaagcatcttacaattttctgatgtaaaaaatactaattagatatcctcccagctatgtaacaatgactggtaaatagatagtaaaataacacatacataaagtattgtattaattcctgaaaatctcacctaattaattttttttaaaaatcagtattactggacaactcctggaaacaattatgtaagcttctcttatctactgaactctgcaggagcctgaagctaagtagctgagacttagaatcgatatcccaagtgttatttcaaatatggtggttgtataacaaataatacttaattaaaaagacttttagtgaaaatgtttagaactttgattctaaagacactcttaataatctgtcctatctggaagacaatttaagtattttcagactaacattatttggcttaatttacaaactattgattttatttgcaattattaaaaaattagtcaattctcattattcatggattacatataaacaaatttgttaaatttgcttgctaaaatttacttgtaaccctggaaatcaatacttgtggagcatttgtagttatttgtggacatgcacagggcagtgagaaatttgagtcaccgatgtgcatgttcctgctgaggtcaagtaagactatactctgtcgtgccatgtttttctaattttgtgcttttttattggtgattctgctgtttaaaatggctgccaaacccactgcagaagtgctgtgtagtgttccttagtgtaagaagactgatgtcctgtacagaaaatatttgtgttagataaattttgatcaggcatgagtaataagtgctttagtaatgagttcaatgttcatacaacctatgataaataaggttctttaaacaggaatacacataaaataaggttatgtattgactggttgattggagttttgtgaccagaggctttcaggaacttaaccctctatttcccctaaaagcaatggttcagtagtcactaatgtagtgtttgtaagtgacttcatggaacataaccaccatgcatactgagaattgactgtagaagtttccagtcttgtaattttaaatataaaatttctggtctttcaggtttactttgctttgtaagagagctttatgtgtttataagaagtctgtctgaagattatgtctttgcaaattaagcaataatttccaatcaatttaagagtgtgagaactacttatcttccattttgactgaacagttaacatttgtgcatctgttttttctgtctcctactaattctttgattactaatatttttctcttcatctctctagctgctctctttgtctcacctagatgaaccacccagagaccccctacaactgttctttccgcttttacacttgtcttttgtaacacaatttgcaaaagcagacagaatggtcttcttaaaaaggaaatctgatcttatcactcctgcgtgtaaaagccccatggatggttgcccttgaaataaaatccaagctcacaacagtggcccatagctgcttttggtctagctcctgtgctggtgtcttgagtcatacctcaaactacattccctttgcttgccaggcccctttcaagcgtctcttttgtgagttataaaaaggcaggcattctcacctcatgctgtcaatgcatgtgatcaattaggtctaaagtatttttctaaggtctgtgcacctttcaccctaggcctccatggagacattatccttgaccactctatcaagtaaatgcctggccccacccctccttccagctccatgttctcactccttttcatcgtatctctggtgacaaataatggctggggcctattgcatcttgcatttcagaaaagctgaagttaataatatttccatttggggtcatttttggaaataagtactatctccccattacttatccttaatacattttttttaaataacacatctgtatttagaatccacttcatttaaaaatgatctattatttatttggttctttatgtgatctgataactttttataattgagatggaggtatgtcatttttccacctttcatccaagtgatttctcaagtgattcctctctacagaattcatgttttataaatgtgtacaaagagaaaatgagatatgacggttgttgtagcctcaccgctgctgagcgtgtgaatccaactatgccatgctttgaagcacaataaaccggctgctgtgcaacgggcatgagtcctgaaacagacaaatataacatttaaatgctttgatgaaaaaataagtagactatacccagtaatgaaaatgcaaatgaatattttgtgataatttcaatttaagatgaatctgaataacacagtaacataaaaccagatagctttgtgaaactcagtagcctaagtgtagtttatttgctccatgacccgtgtcgtccagaatttatagtagctaagttacacagagatacagccaagagttatatgtgtttttctgcctccccaggccttctggaaagtcaaggaaagtaaatggtatctaaaacacaaagaaaatcatctttaaagtcagtaaattaccacctaagtttccatttttaagtctggattttaaaaagtatatattctacatttttaaagcttcctaatggctgaaggaatttgaatcttcagagagtcttggagattattagtcttcactacaaattagtatgcaatttcctgtcaccaatctgtcttgaacaatgcctccaaaagtttaagaaaattaaaagttaacttcttctttttatttgatctattgtagatgcctagatctttttgtcctatgacttaggaagatagaaataaacatttgtggtcctattttatttcctttcataattatgtagtcaactatgaaattcaatcaattacagaatgttttattttgtaattttccacatatgcacaacagtaactgattaaattcatggtctggagagaaaaaacagtatagcatatacctatagcatctcttctcccccaactccagcctagctcagctctccgaaaagacacaaaacaacaacaataaaaacctattttactctagtaactattattatcaagcttatttctcaaaattgttaattatctaatcagcaatcaaattgaaccagagtcattcttgtatttgtttttgactaatttggattaacttgttttaatgctttttaagtttgtgacttctctgagtcaagtaacagtgatccctgattattatactatatttaatatcaaatgtcatgctaataataccaaattattctgctgagacatgctcatctccacccagctaactattcccagaatgccaccaatcatttgagggtgttgggccaaagttcagcaataaatgcagaccataaccactccctgggtgcctgccaggtttcaatttataaagtatgtttgcacaagggcagtttaaatccctgaggatggtagatcacacctagtgtgtccacccaatgatttcaaagtattgttaatatgttgcttctcttgttgtcattgttgttgttaagtaaaatgtgtaagttaattaagtttgtcagtgtcagtcaacaagaatttatgatgtttccacaggctacataggtatactaggagtggaagataaagggaataaaaaagtataaccaggagttgctgcttctggttcttgttagtccctgctttacccattccttaaatgtttatgagacaaaggcagtggtttcaggacaatgttcatatatagcaggaaatgcagcatgaaccttaatcagagataaactagttcacacagccgcaagaactacaaagacattgttcataagagttgtcaaagatgaatttgaaatgaatttttgttacatatgcagagatgatgaactttggaaccccagctagttcaaggtgtcatagaggcgaaagaaatatactgctttgtgggttctggtaataagcaaagacaacatacatactttccttaaaggtggattcgtaaatgcaactggaatgtgaaagaaattgcttgcagtttttaaatggcagttggttttatgaatcttgtaacattctaatcacattttcactgctattctgcaaaatgtttacccttgcattgctttcactttcttttctttctttttctttcttttttttttttttttttttttttttttgagacagagtctcgctctatcaacagactggagtgcagtggcctgatctctgttcacttcaacttctgcctcctggattcaagggattctcctgcctcagcctcccaagtagctggaactacaggtatgcgccacggtgcccagctaatttttgtatttttagtagagatggggtttcaccatgttggccaggatggtcttgatttcctgacctcatgatccacctgccttggcctcccaaagtgctgggattacaggcatgagccaccatggccggcctcactttctctctctctctttctctctctctctctcttccccccgccccataccttccctcccttcctttctgcccccttctctctcttttgagacagagtctagctctattgcccaggctggagtgcagtggcaggaccatggcttactgaagccttgacctacttggctcaagcaatcctcccatctcagcctcctgagtagctgggactgcaggcattagccaccacgcccagctaatttttgtatgtttggtagagataggatttcaccatgttgcctagctgatcttgaactactgagctcaagcaatgcacctgccttggcctcccaaagtgctgggattacaggcctgagccacagcactggcccctcactttttagtattagatgaaaacctacacaaatcaatttcagacattcagaaaccaagtttccttttttcattttttttttacagcttcatggagatctaattgacatacaataaaactgcacgtattgaaagtatacagtttgataagttttgacatatgtatataccaatgaaaccatgaccagtcaagataatgaacatgtccatcaccctaaaagtttccttgtgccccttggtaatccctttctgctgcccctctcctccccacaggcaaccactgatctgctttgtgttactatactttgcattttctaaaatttatataatgtaatcatatagtataaattatattgttgtctgacttttcactcaggatagctgttttgagattcatccatgttgtaatgtgtaaggaacattctatttttttcaattgtttcatttagtcaagttgttaattgaagtttttttttctttttttccctaatataggtagattttaactggtgcttcttatgttttgaacaggcagggtggatttgcagtgctttctctccaacttgcaaactgactctcaatgtagaaatttactacctatacttcagtttgttgctttgaaaatgaagcctaaatggagggagaaaagctcttgttgttttattatttttgacaatgattttagttgggggtggacattttttaggaatccaacattttctactgcatctgattcatttttcttctgtaggtatagtattattgctactgtggtgtagcttcaggattggttaaccacgcttccactacttactgtaggcccacaacaccaacatagaatttgtttccatgtgcttcaaataaaaattgtgttctggggctggtaataagggtcagctcatagagttagactaagtgtgcacggtatgactctggagacacaatttacaaggtagttggtgtaaactgtgccgcttatgttcctaccatttacaacctgcacaactatacatggtagtcatctcttggagagtaggtgactgagcaaaaggacagaataaaccagcccaggtaggaagagaagcaattaagtgttgtgtaacagaaattacggatgaaagtattttaagagacttaaaatggtcactgatatcaactgcagaaacagaatcactctgagatataaacatatctcagttattacccatctaaaaataatacttattttttctccagctaccaccttgtttctcttttcaatggaaagtcctcagaagagttattatatgccttgcattgtctccactttcttgacctcctatttgctctacaactcattcccatcaggctttcatctgatcactccagtcaaacagatcttatggaggctgccaatgagcaatggtttgctaaggctaaatctctgtctcattttccttgatcccttcctcagcagcaactagcacagccatgctttccttgaaacatttcctcctccaggctggtctcctatctcacattcactggcagcttcttcttcatgtctttggctggctcctcttccttgactagacccataaacatgctggaaaactccagagatatacctggtcctctttgcttttctatgaacactctttccctacatgattttattcactcctgaggataaaaattaattctctcaatttgtctctctcaatctttgtatgacacacacacacacacacactcaaatttaaaatacttatctcaagccaagacctcttactctgccttgaactctagagagggagccttgggttacttcttgtaatatttcctagcagttttctctccttaaactatagtgggtgctcagcctgggcaacacagtgagactctgtctcaaacaacaaacgaaaaagaaaatatgataaatatcagatgttataggaaatttcaaattaaaacaacaatgagattctactacacacattagaatggctaaaatttaaatgctgaagacaccaaatactgatgaatatgtcaagaaacaagaactccaattcattgctggtgcgaatgcaaaatggcacagccactttggaagacaatttagcaatttctttcaaaagtaaacatgcaatacaatccaacatttagttccttggcatttactcaaagaactgaaaacatgcttgcacaaaaatctgtgtgtggatgcttatagcagctttattaattgccaaaacttggaagcaacctagtgtcctttagtagttgaatgaacaaataaactgtggtatattcagataatggaataatattcaactctaacaaagggctatcaagccatgaaaagatatggaggaaacgtaaatgcatattactaagtgaaagaagccaacctgaaaaggctacatactgtatgattccaactatatgacatctggaaaaggcaaaactatggagacagttgaaagatcagtggttaccaggaggtggtgggaggaagggatgaacaggtggagaacagggtttttagggtagtaaaccactctgtttgatattatagtggtagatatatgttattatacctttgttcaagcctacagattgtacaacatcaagagtaaaccagatgaaacctcaaataattattttattgacctatttatcggttcatccacattgtactttttaatgaaaatgtatcttttgcactaaaatgccacaaatctggtatagtgtcctaacttggtttgatttctgaaccttggcaaactggactgtttctaatcttaaatcaacaggctctacagaagtaaattcacataagaactatgtgtttagttccttttaaatgcaaagtataatgaagtaatattttaaatatactcaattgaagtgtgtaaaaccaatgggaggacccctgttgcaggacgaaggtggaattttaccggttgaagagccagataccagtataatgactataggaccagttactataactaatatgggttttttttaatcttgcaaattaattctcaaaattagggagcacatggaaatattctgtcacaacattaagggatttaagaatagcaacaacaataaaacaaaggattgtgaccatgtgagagcagtctctgcttttaaagaaatggcattttgtttaacattgtgagaaatcctgtgtgcttaaaaatagataccttatattaaaatagttaagaacagtatttttcagtacctctgataggcccaccattgtgcaagtttatttatagaaatacacaatggctctttttaaaatataccaagtataattagtagcagatttatgtctgtcacaactgtaaagttacagaaaaaaaaatcagtagagggagaaattctacccacaaaacaaagaaatattttctaaaaccactcaggataataacactaaacaattagactgacgaaataatatatatagcacttaaaatacctgaaagcatttaaaatatctgaaaattacatgtgtactaatagaacaaagaaagtcattcagaaaaaaaaatgtaaattccatctctacattagttcttctattcttcataatctttctacccatatttacaaaagccagttttaatcatttcacagaaggtaaaaaagctcaaaaagatttttttgcaaaaacagaaacctcctcagacagggcagtcatactaaatccgcaaacaagatttgcttttaaggagagagaaaccatgtagaatggactatataaaaatgctgaaaattcaacttagggaaataaatggtgaatctaaggatgctgatactcgtatgataacctggagttctgtaactacgctaaaaaagcaggaatctaaagctgtcacattttctttacaaccaacaacaacaaaaaaatgtgtacccgtctgtctgttttaaccaccacttctccaacttgaagaaaaaagggagaactagcaagaaatatttatctacgattcgtgcatacacctgaccaaagtaactggtgaacttcctcatttgtgattttccgcataatggaacaccttatctgatggctgttttttttctcattcttatgggtgccattaagttatgctttagagtgtgacacgacattaaaaagtgacacatgcggccgggcgcggtggctgacgcctgtaatcccagcactttgggaggccgaggtgggcggatcacgaggtcaggagatggtgaccatcctggctaacacggtgaaaccccgtctctactaaaaatacaaaaaattagccaggcgtggtggcgggcgcctgtagtctcagctactcaggaggctgaggcaggagaatggcgtgaacccgaaaggcggagcttgcagtgagccgagattgcgccaccgcactccagcctgggcgacagagcgagactccgtctcaaaaaaaaaaaaaaaaaaagtgacacatgctttcataaaaccactatatattctataacaaaaatcttcccagaaagatatgtttaatagcaatttctagtgactcagacagttgctactagtgttcagtcattgcctaggctgtggtcagaggaaactgacagaagctcccttacccattcaaagaatatccatccctatgcatactagtggctggcttcttaaagtgtggttcaaggagcggtatcacctgggagcacaatttcaggagccatctctgtcctatcgaaatcagaatctgcatctgacaaagtccctagacatattaaatctgagaagcactgttctagaagactattcgtttctcagtagccctctcattcctatgttaagaaacctcgaatctctcatctatccttcaaaatgcctcatttacaaatatttaatcattcctactgattacttctactatgtgtcttttaaactattttaagccaaaagagagcaaaatggactctgcagagtccatttgggagaactttgccagcactaagcaggaagggtggctcccatactcatggcagttggcatctgagcacttatgaatcacagcataggaacagtacatccactctatgacacaggctaaaatggagcaaaataaaattgcttttattaccactgctaattcccacattcttcaagatctgtttgagattcattgttcaactataaattggagataattaaattgacctctattgtagagacttgtaaaagttagatgtggatgtcataaagccaatagtttaccacaatgcctggagcttggcaattgctcaatatgtgttaggcctgcttccttatcacgagagcagtagtagagggtggtgccatgcgattttcttacctttggcccagagatagaagaagatgatcaatgttttatttcacctggaatttctggatattctagtccattcttcggctattggagtcccaaggccttgcaacttaaatatcatgcttctgggttttttgattttttttttttttcttttgagagacaaggtctcactatattgcccaggctggagtgcagtagtgcaatcatagctcactgcagctttgaactcctaggctgaagaaatcctcccacctcagcctcctgagtagctaggaacacaggtgtgcaccatcacacccagctaatttttaaaaatttttatacagatgaggtctcattctgttgcccatgctggtctctaactcctggcctcaagtgatcctcctgccttggcctcccaaagcattgtgattataggtgtgagccatgacacctggccaatgcttctgtttaaacagtttatgtcatggaaattatttggttctgtcatcttgataagagacactgatatacagctcttggggtagaaactttgcctagttactttaatatctccatttcccttctgcaaatgctcaacatatgtttgattaagttgaaatttttatttaaggtagtaattttagcacttctaccttaacacaaattatgagctaattatattattatagataaaacttatagcacaagcagatatgccactgggttgttacttaagacatgctgaaaattttgtatgatttttaaatattttctggagactccaatgttttgacttctgagtaaataagaccctcatggtatctctcacaaaatgctactgagtgacagagcatgtccctagtgaacaccacagcctcactaactgaatatgtagcagggttggtaggtaggctccttttcctgtgacaataacttttcctttcccacaatctgaagcaattaaatacttaagaactgcgcctgtaatcccagcacttcgggaggctgaggcaggcagatcacctgaggtcaggagttcgataccagcctggctagcatgatgaaatcccgtttctactaaaaatacaaaaaaaaaaaaagccagacgtggtggtgtgcacctgtaatcccagctactggggaggctgaggcaggagaattgctttaacctgagaggtgttggttgtagtgagccgagatcgcgccattgcactccagcctgggtgacacgagtgaaactctgtctcaaaacaaacaaacaaacaaacaaacaaacaaacaaacaaacggagtgcatttgactcatgagatgttttaatggagcatagctgtttgattatctgcattaaaccagacttcgttcttctattgttccttccaactttgttttaatagttcaggatggatgtggcaaaattagtgtctgtttgtatattatgtttataaataaaaactcgtgtagaaaagtccatgtgggttaaccacactcagaacaacttgtggaactccagactagagcatacccatcccataatctgctgaggaatcattgtctacttaactactcctgtttattaaacctattaattgcatttgatactctgtctgcgtcagtggtcattactcattaacttctctactcaaaccagtgtgccaacttaaggttttactgtgacagtgaaggactccactgtatccacgctagagatcatgaggataggccctgttgagttgaatactgaatattacccacagccattccttcaatagagtaagcagtacagagaaaaacaggaaaaaaaaatctgtgaggaagcaaggtttggaaaacacagagtaggcaaatattagaagtactctgttaactccttaaagattatttttgtgctctcacctcttcctacatgctatgactcaagggcataaaattgttgataccatttctgagggaatgatgaagacggaggggtcctcttttgccttctcccattattacaatatcctgaatttttatcaaactaatttcattatgggaagaattggaggctctccgttggtggataaaatacaaggcaattcattttaagactttgtgagttgaaggcatgttagtgggagccctggatgggaaaggaagtagactgtccacattggccagtggcaacgaggaaacagtataaacacaagaggtgcggaggctggaattacgaagagagggtgccaaggacaacttctgaaaatggagagagtagtaagccaagcagagggaacaatgacaaacttaagctatttaaccattttacatagtgttgccttgtacatgtggaggaaaatcagagggagaagcagtttgtaatgcaatattattcattaaattgtaccagtgccaggaaagtaatttaaaaccaaagcaatcttatcactgaatttatatcaagtcatcgttttatctgcatgaatagagaaatgcccacacatgattgcaaatgttgtatctgacataggtaaaaagaggattaacacctggggttggcgggaggtggcggtgagcgggatgacaaagcaagctcctagccaacaaagcaaagtggacatcaaattgcaagccttaaactgctctgctcaatggcatgttttgacttgtgacactggtaagctccccagatatttttaggactttactggaagtatcaaatggggcaaaagcttaagatttcactgaaggtttagtaatgcagccatgagattagagctgtgcccatgaagcctgaagagactagcaaattgcaagggtttattcaattgaaacgatttcagttgcttttacttttctgttaggctgggataaatacaggtagattaacaaataaatgcatagatattagagatagataaataatctagtggttaaaattctaagaagacttgtaccaggctatttgcatgtgaattccagctctgaggcttacttgatgtataagcttaggcaagatatttcacacttctcctgccttagtttcctcattttcaaaatggaaattatatagagtttacctcacagggttgttgtgaggattaaatgagttaatgtacagtgtttaaaatgatatcaggtaaacagtgctcaataaatgatattatatatttgaatattttaaacagataaaaggcagtaattctacattgcatttctttattcatgctctttggggcaaggaagcaccctcttatggtaaagaatttctcccagatcgtcctaaattgatccaactctgaggctttcagccttccaaagaatgaaatcagtgcctccagtgacataaaggccaggggctccttgtagaatattcatggtactccaagctttgctgaccctcttagctttatgaaagaatacagagaattatcaatcttgatcacagccccaggtttttaaatatttaaacttttaagaaaatactaaatatctctttttaattctccagtcacttgtttttttcttatgattttatttcaaaatagtatagatttagctttgccaatttgcttttagggtttcagtctcccacagcttaacatttggccctctctggaacacatacccctttcaaatattgcccgtgcgctcaccttttaaagtatcattaggattaaaatgttataatttataagtagttgtaccactaggaaaaagaatctgattaccctgaaaaatttatagaaataggtttgtaatagctttagggacatgattttgactttaagcgacccagaaaatgagatgctagtctatttttgagaacttctaaaggagatttctaaatctcctctggtggcagctttacagtgatataaaagaaccatttgataatcattcctagagggatgagacaaatgctgagaatcagacagaggttcaatcacaggtacctccaaacccaacttcccaaatcactggagctgagatgccaaggttggggtggggtgtggggctgaaatttctattctgaaatcaccacattaactaaaaccaaacagataattttttaaagtctcacttttttggacaagatagcttagatttgctgtccatgttgatcagacttcttaaacttcacaatttcacttgaactattcaagaatcattgatgattttttcctagagttttaaaaagtaaagtcacttgactcagttgctccaaaaagtccagtcagaggtttaaggctagtattgaaggataagatatcagctgatactaaatcatactactctgaaaatactatagtttaggattgcatgctgtggaaaagatgattagctgccctctgaaatccattcttctcttaggcacacagctagactgcatttcccagacagactcgcttacagttaggtgaaacatgagctcaagttctatactgaaatgtgagcagaaggtctgccattactgggctggggttcttaaaagagtagccatgcctcctccatgttcttcttctctttctgctagagaaaaaggaatccagcagttctaaagtaaccctgggagctccctgctgaagacggcagaacttctgccagccaggttttcaaatgtctgcatacagaagagatacctgcaacaaggatcttgcctcagactgatgtacgagttaaggaatgtgcttatactacatgtaagtttggctttatttattagtttaacatatcttaactatgatatatgccatattttaaaattacacactgttactaaaatcacatgggagcagagacatcttaacttcactttagtgctttttactttgccaaaggtgctttcacatgcattattgcttaggagtctcaccacaacctttgaaaaatattggctctaaaaaaaaattatatatattttttcaaatattactgcagtaagataactttaaaagccacaagttaaattaagagaaataaacatatttttcaaacttttgatattttgcaatagaaaattccatggaactataaaacgatcagatttttaatttccaacttgagctgataataaatatgctttgaagatttgtttttgtggtccaaattaccagtaagaaaatgttacatttaatgtaataattgcccttacctgctaaagatgacatattgataatgatgccgccttcacctccattttgcttactcatgtaatccaaaccaagataggttccactgataacagaaacctaatccagaggcataagtgagaaaaggaatacagtcattatcctttcccatattttcacacaccaaagtttttatagctattccagatacctagggagatttctgcaaatattatcaatgaaaggttttaaaagagctttgtttttaaagttagtcattaaacctggattctttgggtttgcctaatcattgtggagcttgtcatatatctgcaaaacttcacttagttgcccaatatgagattttatgctacaggttgtattccaaaaatgtctattactttcactcaattctcaacatcttcaataattccatatattctttttgttttctaaatgttggatgcaaaatttatttacccttcttctctgcatatggttctcatgtctcagtattccacacttaactactctgtttaattctcttggatcttggaatatagaataatgcttactcttgatttcctagaggttttattttctccttttttctttctaataaaagttctattttgctcctgtatctacctcctctccatataatacgaggaaggtgatctccccaaatttaatgtagacactgattaattaatttaattcagtcatggaaatcccattctccttgacagtggctggtttcagagccagcaggtgacccagttttggtcagtgagacctgggaggcaatcagctagagatgggaacaggatggatgctgctgagaaattttttgttgctcttaagaaaacctgaagaaatggttacattgcctgctttatatgaatgtcgtaacttaaatggacaacccctatttcctagtatcctgaagatgaaaccaacataaagaatggtcggtgggagggatgacacaaccctgggcccgatgatatcattgacctgtaagatcaagcaatcctcaactccgtgttgtgtgaaatcacataaatgttttatccagtttaagtggtgattgtcagttagctggacatctggtctttagtaatgtctataactaaattttattaatcactgcttacagctatccttttgatagttgactgttttgccacttatatccatgtgtaggcacttttcctgtttttgttcaaatcactaccaaaaaaaaaaaagaaaaaaaaaaacctgtgtgatcaaattgatatttcaaaccttacttttccttttggatttaagaattcctatcccttccagctcagacttttaaaaaaggaaaattcttttttgacatcttaattcctatttttttcatgctttacaatactgcaaagaaaacgatacaataggtaatgcgtctgaaacggaggttacacatgtacttaccttctttttctcttaaaaatttccttttgaagttttcttttttttgcaaggattcagatatacttctcctacctaacagtagctcttgaacaaaaaaggaaattggaggttctattcacttaagccatgtgtcaatttgacagtaagtaggcttagggagaatgaataaaatctccacatgattttctttagaaaggaaaaccaaaacattaattgtttatataagaagaaaaagatgtagatggctgaaattaatgaagccagttggattctgttagtttctgcagaaggcttcagcatgtctgaacagaatttctgttcatgcgtattggcactacgcttttattctcaggtattacagctttgctgacaccccactgttgtgttttcgacatgaacaagatgaagccagatagaaaatttgagattttttaagatttatttttaattttttagaaaagcaatatttatctttaggtctttggtggagaaaggcaagggattatttttctcatccattatcaggttaagaactgggtaatttttcaaatgaaagagttcaaaggatgaatctacaagacagggtctaatgctttggctgtgtagaaatgacatttttcacttttcctcctttactataacaacgtagtccttattctagattatatacgcatgtgcacgtgtgtctatatattatatatttcaccatgttggccaggctggtctcgaactcctgacctcaactaatccgcccacctcagcctcccaaagtgctgggattacaggcctgagccaccgtgcctggccagaaaatgtagattttgatgctctggaagggaagtgtaatttattgaataaattctatgcagtggcactgtgctggatattcacataaactatggtttatttaagcgtaacagtccttagagatagggagtttaccttcctccctgggaagctcaatatgagagaaataaaataacagtttataaattatagagtcaagactggattctaattttgactaatcccaaagaaatgtatttcccagggcaaatctttagtcaataagtgcatttcagaaaaaaaaaaaaaatgactagcaacattcatttattttgtttaaatcttatttgaatatattgacccacttatgcctagtgttccattattggaatactaagcacgtgagagttatttatatcctactgttcaaggtcattgccaaggtctaatttttaactcatgcaaaaattcaaaatattgcaacctctggcataaatgggttaaggaattcaacatatattagttaaatgtcaaaattagactgtaagttccacatcagtggggatgaacatatttaggtttacagaaacttcagaaagttacaaaactacatgacagaattaccattccaatcaatattcaaagttaagtttacctctgcccaattgccagcatgagtgttgatagttttgcaaagactcattctttcctgaacatttcttttttttaattttattttgtttttgagacagagtctcgctctgtcgcccaggctggagtgcagtggcgcaatctcggctcactgcaagctccgcctcccgggttcacgccattcgcctgcctcagcctcctgaataactgggactacaggcgtccgccaccacgcccggctaaatttttgtatttttagtagagacggggtttcatcgtgttagccaggatggtctcaatctcctgaccttgtgatccgcccgcctcggtctcccaaagtgctgggattacaggcgtgagtcaccgctcccggcctgctgaacatttcttctgtgttctgaacagcaatacataatgctgctgttgttggcttcagactaaggaggaagtataaaatagcctaatggaaaccaaagactgggaaaaggtttagtgggaagaaggatgagatcagcaaagtgaaaagtaaggagtaaatttgataaggagtaaaagtagaaggacagatgataccgtttggaagaactaatgtatttggaaagcaatgtactgagacatagaagtgaatactctcatgtatgcaaaatatcatatacaggtaatggcaggtgacccagtaactattaactaacatctgtaaggacacaagacaatagttttctgccttgaaagaacttgtggtttactagcatgaatagcatgaattatgtatatatttaaataattctaataaaattaaaaaactggtaagccctatgaaaatggtataaatatgttgtataatattttagaagaaggagagatatatggtaaagtcttttaagaggttactctctgacatgagcagtaatacagaaaaacatgcaaaagaacaaacatggaattgtataagacccaaggaggcaaattaaatccagagcagagtttcaaaaaagagttatataaactacacacaaatatttgcattacagtaacagagataatcaagttggaagttaaattattggtcagattctactcttgcaacgggtttaggtaggaggggaagtaacatatttttaagtaatacattggtaacaaaggttccatggtgttttctttatgtaaacatatatcatcagttcctgatgtgaagctgaaaagtggcctatgtcagcagagtcccaagaaaaataaaggctggataaatttcaatggagaaggaactaggcctgttagttataactaaaggatcacaataaaattcccctggtcttccagaatttcctatttgcccatgatattggcactttccagctcagagcaggtattcacacaggctacattaaagcaaacatgccctctcagctggatgaagacatcagtcgaattctgtaacttcgtaatatttgcctcaatatttccatgtttctttacgttagctgtaatcattgcacactgtttctgacagctgatttttcagagaaaagacacagcaagtgtccattaggaagtcaccaaatacaggaactatatactctattaattttatctgtaaaaatatctgtagatattaccgatgaagctattacaaatatcagtagtaatgttaaagagagaaagctgttgtgcaatttgtgctttttcactgggatagcctggttcaaagaaaatctcgtcatttaatgtggttttggaaagtggcatgagtctatattcttaaaaatccttgcagttcccaattagccatattttcaaaatttttgttttatcaggctaccaaaagatgtaatgaaatacaactcttaataagtcaggggtatcctccaaagagtaaatataaaatgcatattttttttttttaccagcataagaaaattaaagctatataatgcatttagggaaggaatagaaaaagaataaaaacaaaaagaaaacagtaaatattaaagtataaaacggaagagtaaaaataaatggcttaaactcacaaatattaaaaaggcagatgttcccagttgtgtctaactacagattagaggattctaagatctcacaataaaccatcagcaacaacaaatttaacataaaaggttgcttatatttttaaaataaagtaatggaaaaaggtaggtgaatgtgaatccaaagaaaatgatagggtactaattttatatctgaaaatatagaatagattaaaaaatcatcagacagcaaatcagaagtttaactttaaaaaaaatttaaaaatcaataaattgcaatcattagcaacttatgctctgaatattatagatttataatatatagagtctaaacttacagaattactaaaagaggtaggcagactgccatttgccatttgagataagaatgcctctgttgagaaatgaacagatcaaggacataaaaggaagccaggatatagatgacacccaaaccaaataagaacattataagaaaagaaaattaaggatagtacaatttataagtacagaagcacaaatactaaattaggaattaaaaaaattcaatggtatattaaacattcatatatcataataatggaagatttagccaagagatgtaagtatgattcacagacagaatatctcatttcaatacatttctaccctaaagtagaagaagatcacagaactgtctcaactcaggaaaatcagctatcaggtctctccaaacacatgtatgtatatttgcaattagaatcccaaaaagattttgagggaagcttgacagtttcaagttattttcaaatataatgaaagaggtacactggagaaaaagttttaaaagaactgcaaggagggtatccatactgtaaaatagaaccttccttcttaattaaaagattttaggtaaaattcaacatcttttcatgttaaaaaatcctcaacaacataggcatcgaagtaacataaagcaaacatcttactgagtgggaaaaagctggaagcattcgccttgagagctgaaacaagacaaggatacccactctcaccactcatattcaacatagtactggaaatccaagccagagcaatctggcaagagaaaggaataaagggcatctaaataagaagagaggaagtcaaactatctttttttgcaaacggtatgattctatacatagaaaacaccatagtctctgcccaaagtttcctagaactgataaacaatttaagttacgtttcaggatacataaccaatgtacaaaaatcagtaatgtttccaaacaccaataatgtccaagctaagaggcaaatcaagaatgcaatcccatttacaacaaccacaaaaagaataaaatacctatgaatacagctcaccagcaaggtgaaagatctctacaatgagaattgtaaaacactactgaaaggaatcagagatgtcattattaaatgaaaacacattccatgttcatggataggaagaatcaatattgttaaaatggccatactgctcaaagcaatttacagattcaatgctattcctatcaaactaccatcatcatttccacagaattaaaaaaaacaattttcaaattcatatggaatccaaaaagagtcagaatagtcaaagcaattctaagtaaaatgaacaaagctggaggcatcacactattcgacttcaaactatacaaggctacagtaacccaaacagcacggtactggtacaaaaacagatatatagaccaatggaacagcatggagaagccagaaataaggctgtacacctacaatcatctgatctttgacaaaattgacaaaaacgagcatggggaaaggatgcactattcaataaattgtgctgggataaccaggtagccatatgcagaagattgaaactggaccccttccttacaccatatgtaaaacctaaaactatacaaattctagaagaaaacacaaagcaccccattctgaagacatgccatggcaaagatctcatgatgaagtctccaaaagcaattgcaacaaaaccaaaaatagatgggacctaattaaactaaagagcttctgcacagcaaaagaaactatcaaagcagtaagcagataacctacagaactggagaaaatatttgcaaactatggatctgacaaaggtctaatatacagattatataaggaacttgagcaaatcaacaagcaaaaaccaaacaaccccattaaaaaaagggcaaaggacataaagagacttctgtgaatacttctcagaagaggacagacacatggccaacaaacataaaaaatgctcaatatcactaatcatcagagaaatgcaaatcagaaccacaatgaaatacaatttcacagcgatcagaatggctatcattaagaagtaaaaaataaataaataatggatgttggcttggcgaggctgtagagaaaagggaacacttatatgctgctggtaagaaagtaaactagtcagacaccatggaaagcattttggagcttttctcgaagaacttaaaacagaactaccattcaacccagcaaccccattactgggtatatacccaaaggaacataaatcattctaccaagaaagacacagcactaatagggtcatcgcaacactattcacaatagcaaagacggaatcaacctagatgcccatcaacgggggactggataaagaatacgggtaggtatacagcatgaaacaccacacacccataaaaaaggaaatcatgttggttgcagcaacatggatgcagctggagagcattatcctaagcaaattaatgcaggaacagaaaatcaaatacctcatgttctcacttacaaacaggaacaaaacattaagcacatatggatacaaaggggaacaatagtccccaaggtctacttgaggatgaagggtgggagaagggtgagagtgggaaaactatctatgggttgctatgaccactatctgggtgatgaaatcatctgtacaccaaaccccagtgacacacgatttactcaggtaacaaatctgcacatgtacaccctgaacctaaaataaaagttggaaaagaaaagccaacaaaaataattgaaaaatttaaaaaactaaaagaaaactgtattttagttatctgtcaagtttagggagcaattttgtactcttctcaaggtaggacttacagatttggctcttttgtgaagaagtgtcatcctcattgcctctatcaagttattatagcagttaggtaattactcatgggcatttcaatttaagtaaaaaatgtattgactaagcactatcttcaagatattatgttgattactgagagagagacaaagaaaaacacaacccagttcttgtttttatggagtttataatctactaggaggatatcatgaagtaggaggtcactccctgtacctttatacatacacagtggccaaattgtactctacaattacctgccttgtaagattggtgagaatgaccttagcaaggtcagggagaccccaggcacagcctatttgacatttagttttagttaacgtttgatttttactaaactccaatatcttatgtcaagggtatttatagaatgaggtaacccataaactcatgacttaatggataaaagagaaaattttatttcttaattctaccatttttaagagctaagtcattatcaaacattatggaaatcacacacacacacgaaccacgaactttcaggataaaaagtcctactaattacaaagttcgattgtcactttaattttgttttctgttacattctagcatttaattaagatttacttttaaataaataagtcagcggttgacgagctttttctgtaaagggccagattgtaaatattttagtcattgaatgccacaggatcttttacaaatattaaactttgcccctgtagcatgaaaatagccaatgacaattcttaaatgaatgactgtggctgtgttccaataaaactttatggacactgaaagttgaatttcatataatcatattattcttcttttgaatttatccaccatttagaaatgtaaaatggtatttttagcttgcaggtcataccaaaagagttggcaggctattttggcctgtgggtcatagtctgccaatccctgagttaagcaatcatttatattttattcatgcttctttctaatattttaagatagacttactttcataattaaatgtcttcctttttataaaagaaaatgcttttatccagctttctgtaacttccctttttcaatattgtaggtcattgttttgtttccatgactccaagaacctttttttctttacaaacatcatgttattaaataattatagacaagaaatatagctaagataactcaccaaattaatttgcagagttttttcccagtttttctcattattcactccagcattattgaccaaaatgtccagtcttccaaagtggtctacaacttttctaaaagtgtctaattataaaacaagatattagtgatacattcttattttccatgtatacatttaaatcatgtcctatgccatgagaggaatttcagtttatttaccctcatagtgaaagttactaaactcatgggctgagtgtaattaattccttgtttctcaatgtgtggtttgtggactagaagcatcaatctggcagcttggtaagaatgcagaattttgcagacaccacagactaactgaataagaatcttaactttaacatattcttacatgatttgtatgcacattgaagttctataagcagtaacttaatggggtacattttagagaactgagctaagatcctaagctaagagctcgttgaagtcagttagagcaagcaatgtctcttagtccctgagaagctactgaagctctgtagcttagactattggtaaacatccttttccataagccatattaaattcataaagtgttatgttaatacaaatattcttgtgtattcagatctattatgcatgtttgggggagtttttatatcttagtaaaagtctacttttcattcagttgattttatttgattactgaaacttcgatgtttactatttccttcttctttctcactattattactacttcagattactaggattactagtttgtataaaactatgttcaaacaggataaagttggcatggattctgaggcctgaatgtctttcattacactgtccaatcacatgtctattgtttctcaaagcagcctttgacagagttctaattgatttaaactgtttccccgggcctttgatcattcattctacttctattattttacactatggataaaaattgtggttgtttttctacatgacggaaatatattctcaggtgtccagaccaacatatcaagtccttaaaaaaagtaggtcagcataagctttattttgattgaaataaattcatataatcattaacaaccaccagacatattggggaagacatggattaatcagttgccatatagataaattactatgctagttgtttactaaaaacattttcaagatttcctaatatgtaccttttacactcactgtacgggaatggaagaacaacaaacacaaactgtttatttttcatggatttttttttttttgagtcggagcctcgttctgtcccccaggctggagtgcagtggcctgatctcagctcactgcaagctccacctcccgggttcacgccattctcctgcctcagcctccagagtagctgggactacaggcgcccaccaccacgcccggctaattttttgtatttttagtagagacggggtttcaccgtgttagccaggatgatctctgtcaggcctctgagcccaagctaagccattatatcccctgtgacctgcacatatacatccacatggcctgaagtaactgaagaatcacaaaagtagtgatacttaaatggcctgttcctgccttaactgatgacattccaccacaaaagaagtgaaaatggccggtccttgccttaactgatgacattaccttgtgaaattccatctcctggctcatcctggctcaaaaagctccaccactgagcaccttgtgacccccactgctgcccaccagcgggcaacccccctttttcctttacctacccaaatcttataaaatagccccacccctatttccctttgctgactctcttttccgactcagccagcctgcacccaggtgaaataaacagccttgttgctcacacaaagcctgtttggtggtctcttcacacagacgcgagtgaaagtctcgatctcctgacctcgtgatccgcccgcctcggcctcccaaactgctgggattacaagcgtgaagccactgcacccggccttttttcatggaatcttaaaaatgtttcttaaaatctcaaattgggtccagaaaatgtcccccagtattttttttttctccttccattctgagtatgttctaactcttcataactccacagaaacaaccttcaccttttggaaaatgagggtgttaaatatgtatgtctaattgccgctttaattttctttcctcattctgttctccaccgtattccttatactctgcccttaccaatgtatagtataccatcttgttttctgacatcccattgaattccaggctcaagcaacagacagtctacctcttgctgacatttatatgctatggtactctttgtaacttacctaaactctcttggctgtgatttgttcatttggaaaataagttatgtttagattatctccaagaaacttttcatctcatatttttataatttccacactgtctaaacaattttaaaagttataggcaacattaaatcctgaaactggaagaatcaatgtcatgtttcctttagatgcaagcaaatgctcatgtccagacaacatgtggatttctcatgaccaacatgccttcccgggtcacttatgtgtctgagtatttttcctcctccacaatcatttatccttaaggaatgagtttatagccaaggtattaattttaaatactgggaaaaaaacaattgtagttaaatgtcatttatgaaactatataaattgagacagaaatggctttcagattgtttatactgttccttatgccatcagcatgaatgttgagatctgacctggctctatccttgatccaaaatatcatgtgcaatcaacataattgtcctctggtacaatatgttcctcttgcattgtgtttacaaatctgttctgctcatgcttgtcatctgtgttataggtctttattagcattttcagatttcagttatgtaatttcctttacaatttctcttaactgttggtacaccacttccttctaacacgtcagttcattttcattctcttacagaatattttaaaattttaaaataaatgtacatttgatgtccctttaagaacaggagcactggaataagatttgcaaaagttttcagaccccttgattaaaaagtgccttacaatttactcagtctctttgaataaaactttgtgaaatacaaatattttacttttctagtttttctccagaatttttgtttcctgtaagtttattggggcactctcaagttctccaatagatgtacaaaaaaaaaaaaaacagctttataatcaaagctgtttattgtgtatgccaatattgtccctgatacttcacaagtagattggtctattttaagtgagtagccggaaacaggaaagcattgaggaaaggctgatagagatgtttctactacaattctaacattgtatactttattatgattactattattattattttaaagtactgtctcattggggaaaaagccggagaaaacatatggtcaaaagcatctagcacttctgtgatgatgctccttgaacttgtattctgatatgtttaaacgaaaaacactgccacatttgattgtcattggactccagctttctgggagaagttgtttgtcaacagtaccttacttaacctactttaattttccaagttttgtctgcaatttcaatcatttaataattactgcagcagcactgtctttgaatacataaaggaattttgattacattaatgctgccaaatgactacaataaaaggatttctccagcagtcttgcctttctttcggttttacagctattgggctgtcagaaggaaacgtatcagtccaaactgtcttttggagcttcaaggtagctgctctcgaggaggcagcggaggcggcacccagggccccctggccgggctgccttcaggttgttgcttgttgagagcacgttcccagttgacagattgattcccctgtcttacctctcagttgttgctggtcagccacatcgcactggatgaacagagtcttctgaggttcaaactgctcatccagggcagctttacactgtacacctgcttcaagattccaatccaccagcgctacctatagacaagaggagaggaatcgcgggcctgcgcagctcacgaaatagacggacaaacaataaacacacaagaggctcccctcctggacctgaaatttggcaattaggtttgggttccctcccagccacttctgaggtgtgctcacagcctcagcttcagcaaattttggaagtggcaaagtgggcacgccgggcgcggcctccctgtctccgccagtgcacctcgggcggcggggcgagtctcggagtgtgtgggcagagaaatttccgcggctgggcgccgggcttaccttggcgcccttaagcagcagcgcctctgcaaaggctctgcctatgccctgagccgcgccggtcaccagcgccactttgccgttcacgtgcatggtgcagccactgctggggcgggcggtgggcgagctccgcgtctccgcgcggccgcggcttttatgcccccctgcgcgcgcgcgcgtgcagcccggcggggcgctcccctgccagtgggcggggaggaaactgtcaagccagcgcccgccggggaacccacgactgtgtcacctgccccctgagcgttctggagcgccaagcttcgcgatctttgccttccggactcgcagaccggctcaaagcctcccctcagcctctggctccgtgattggcaggcagctgacagaagaaaagttaaaaggttatttctgaagaagagtttccttcagtgccctaaagaccaactggatagaaggagagcggagcagaggcttggaagcttggatccctcctcctgcactccctcccggccccgactccggaacaaaacaagcaaacaataaagcaaacttgttgctcttttgtctcaaagttttgtgtgagttcccatctcgtaatcagtggggttgagggtgacggggagcagaagtaactaatatcattgtgttttcttagttacattttggacaaatttttacggatactggagatgagaagtggactctgctctgtcctgaaaacctggaatcataacatttcatggctaggactagagtgtccttggcgctgtgtttctggtcagtgtcaattgtgtgtcatattgagatgcccccacaaaaactgtcatcatcaacaggcgctccagagccgctggtagcctaccaaattgttggctcaatggaatgcttacttgttgaaatacaccaactttggaagctctgagtcaagtttgggacagaggttccttgctctccaggaactccagggctagctgtatgcggacttgcataaataacaagggctattccactgactttgtctctttttctcaggttgtcagcggcaggctgcaattttaattctgtaaacgtaagtggttggctttttttttttttttttttttttaatcttgagacaagatctcgctctgtctgtttggctagaatgcagtggcataatcccagctcgctgcaacctcaatctccagggctcaagcgaccctcccaccttggactcccaaagagtgctaagattacaggcatgagccactatgcccagctggcatttattttcttaaagaaaaaaaaaatctaaatacttgggggaaatgggagttgagcaaaagactgacactaacagcagaatgaatcatttttatatcttctttaccttctttactgggaaaggtggctggctcagcagggaaggagtgtatgaggagactgtgtaaaatgtgtcttgtcgcgttgttggtaagccgctaagcaaatgtctttaacattaatttgaaattaggtcttgacaaaatcttgagaaattaaaacaggaaaatagatatttgtactctaggatgataattaaaattgtaatatgaagagtaaattgaggggtcatattgaaagggaataatagtagaagacaaaaagaaaacaaggaaccaaacaaaacttcagctcctctaatggcatgcacagaacatagaagtttctgatgaaggaactggcaaaaaagacagaaaaggaactgctggggtaaaatggcaacatgctgggagaacacaggtttgcagctcttgtgggagaaatactttcaagaagaaagaagtagttaataatgcaaaatactcaggtgagcaccagggaataaaggatggagaaatattttgaatttttcaggacaatatttagtgtgagtaaatttagaaggcacaaaaactgaacagctgaaatgatctgtgagaagatagatattgtcatggactgaagaccaaggttacatggaaagagaaatggactggataatagttgaaaagattagacagcaaacatgtttttcttttaagaaaagataagaagattgattgaggtcaaagtgcaatgagtcaaggatagtgacaactggaagaacaggaagcagtttggcggtggcggataggtgaggcacaaggacgtcagcactggattcagacaaaccgggtttggatcttgtgtctgctactgaccagctgtgtaaccttgggcaatttgcttcaactctgggtctcagattccttattataaagtaagcttttctaaaaaaaaaaaaaaaggtgaaaattaaaataggtgaagcatattaaacactattacagagcctgccacaaagtattaatacattaatattagtcccaacatattacttctgaaatattaatgaataataaatgtgagatagagaaaaatgtgaagaataggtttttttagtagatagcaaggactgaggtctagagaaaacttagtaccccttcatccctttccctcctctcaatttccactgccactgtccagattcatattttctcctatgatagcaaacagcagttagcttctcattacctccaaatacgccccccactttttttcgcattgtgagatgcttttattacagtgaattaaactgcttaccaaacagtgatctttgtaaggaaggattttttccctttttagttgacatggaataactgtgcatatttatgtgatctatatatacagagtgatatatatgtacggagtgatatatcaatacatgtatacaatgtatagtgacaaaatcaggatatttgattattagcatatttattaactcaaatgtttatcattgcttgtgttgtgtacattcaaaatcctctcttctggcttttagaacctatacactaaattattgttaaccatattcaccttacatgtgttctagaaaacactagaacttatcctctaatctagctgtttcttcgtatccgtaaaccagcctctccctatacacatctccccttacccttcccagcctctgataaccacaattctactctctacttctataaggtttttttttagctttcacatatgactaagaacatgcaatatttatctttctgtacctgacttatttcatttaattgctccacatttcttaaatccaatttaccttctgcacttctcctaggaaaatttctaaaactgatctgatcgtgtttagatattctcatgtttaaaatccttaaaatatctaaactcctgggcatcacatctgaggtgttccatgccccatgtctttcttgtggcccttctttacatgccaggaagctgtgtgtcagtcacaggtttagcatccctgatctaaaaatctgaaatcctaattgctccaaaatctgagccttcctggactgtgatgtaagcaagatataaacttcttatctgttgagcctttgcatgtttgtttctattttctatcacagcctaacctaatatatctcccaatagaaaaaatcctcccaaatgtccctgatgactaaatcatgtagaacacggggcaaattaaatctttttggtagatagccatcagggcaaccaaattggctaacctactagatcatttattgccataaagtctccaaatagacataaattacttacttatctagcaaaacaaagatagtgtcattatacactgcctccctggcccccactcctaagcaataatcttttttaaatgaaagtttttgttaaaaagtgctccaacaatctgaaacatgacaagtggaaaattccacatgtaagtactagatacaaacttggtttcatgtacaaaattattaaaatgcaaaagattattttcaggctatatgtataatatgtatgtgaaacaaataaattttatggttagacttaggtctcagccccaaggtatctcattatgtacatgcaaatacaaaatccccccaaaattctgaaatctgaaatacttctagtcctaagcattttggataagggacactcacctgtatagcctataaataagaatgttcttacaaaattatatggatgatggtttatctcaaatttaactttgttttagctaagaattatgtttttaataacacaaatcactgtgatgacagaaatatatagctgatgtaatgtcctgaacatagaagctgagaaatgcatataaaaatcagaggagtggggagatgttgactgggtaagcagcccttttttggttttataatataccacatataatgttctatagatattttaaattcaaaatagacttttaatataaaatatgggaacattcttctccaaaaacccattatcaatatatttctgttatataaaaagataatcacaacatatgggaaatctcaccatcctattaaaattttccatcttctcttgaacacatatctcatatttatatatacttttctttggtcagcgtgtattgcgcgtgtactttgggtggccctgtgctgcgtcagctggaagggatccagagaaaaagacagagccctctttgaagacatccagagagagtaagctccttatgatcctgtgattggtatttccatggtagagatctgatagctgcataggaaaacagttgaagaaagtgggagggcaaagatactcaagaggagcgggtatcaaacggcaaaggcctgagggcatggagagtggctatgttttaactgacacatggcttcctagcatgtagagagctgtatttgatttagttttgcaaacgaagttctcttaaaaacaaatgcagcgcaatgatgcaaagttaagagaggtgattattcctttaatgcaattacaagtgttgagtgttgaacatttactcagaagcagccatctcttactgtctacacatacagcctctggaatcagaccgcttgggttttaatccagctctaccatctactagctctgtgacttttggatagttacttaatttatctgaatctcagcttcctcatcagtaaaatgaggataatagcagcacctatttcataaagttgttgtgaagactatactaagttagatacaagtcaagtgcttagaccagtgaccggcacatagcaaatgttatataaatgctattatcattaagcactatacatatataattgcgtttattatttacaaccaagctgtgaggtagttattattgtggtaattttatagatgagcaaaacacgtttaaggagtttggggaatctggtcaaggtcacttatctagaaaatgaaggaggaggctttgacacaaggtgtggctgactactgagtattacttcttttttgaaaattaaactcttaattttgagataactgtagctgagcagtacttttagccctgtctgaatggcgatttatttaagaaatacaagttgaatatagactgaaatcagcactctttgagcaaatatatattttcccataccctagtgtctgtcagctcagttctgacctgttaggccaggctagtcttaaattgatttttcctttatcccatgcacactggtgagcacagacattccaagaagcactcaatcacaggcccaggctcagaggcaggccagtcactcacctgatagacatgtttactgaattttaaaataatgacatatcaatcaatacaaaaataagctttttctttattgaaacaaacaaacaaaaaccactgctggcataagacagttactgctagtactggggtctggggcttgttttgactttgctaccacaagctacaatagaggagctgactttttaaatagctactatgtttttgttcctttgtaagttatttcatttagttttcttgctaaccctgcaaggtaagtagtagtatcctcattttacagttgaagaaaatgagcctcatggaagacaagggactgataccagaacttagcaacaaacttgggtacacatccaagtcacatggctccaaagcctttgctttgtctactccactgaattctcttagatctacattcaaatgctgtctcatcccctttgctaattgtatgatctttgggtgattacgtaacctctctgatcctgtttcctgagctgttaaaaggggaacaaaatgacattccttgaagcacccagtacaatgcctggcacaaatttggtgatcaatgaaatattcttattaagtttcttccttaatattcatatttatttctggattaagagatacttagttgaaaatggagaaagaacaatgatacagatagattttcaactccagaatatggtgagatgtttctaacttttcttggtgtttcccagggctgctataacaaaataccatagacttggtggcttaaacaacagaaatttattgtctcacaattcctgaggctggaagtccaagatcaaggttttggaaggtttggtttcttcaggcctctctccttggctttcagatggtcactttctcgctgcgtcctcacacggctttttctctgtgaatgtgtgtctgtgtgtgtgtccaaatttcctcttcttataaggacactagcaagattggattacagtccgcatggtcttattttaacttaatcacctctttaaaggctctaacttcaaatagagctacattctcaggtattaggtggtagggattcaatgtaaggatttgtgggggaatacacaattcagcccacaaaacatagattttccaatctggaaatggaattctgtttactgactaaactatactggggaaaccaacagatggatgcattaaggattgagccagtcttgtgacttgtacttaacaaaacacacattcctgcaaatggcaagaacagaaaggcagttcagttcagtaacgggagaagcatctaatggtcaaagttattcagttgccaaatggtcaagtggtggtaatctgtgacacagagaaagaggaaaagaaattcatcacttacaggtggacctgaaggctgaggaagaatttttgaaaaatttctacccatgtgttccaatattgggtggtatcagttataaacaactactctaaagtaacttctacttaataggttgtgctcatataatttgtacaatttattcaacaaatgtgttttggccaccacagatatgtcctgtactagggcatgagtacatgcagtaaataaaacaaatgatcttacctccatggagcttgtagcctctttggggatgcagacaataatttggtcacaggcaggtatatgggagcgcatgtcagaggggcttaacatggtgaggtagaagaggcaagtctcctgtaggaagtgctatttctcctgaagtctgaaaaatgtttatgggtagaatagaagttaggagaagggaagaaggggtagtgcaaaacagaaggagctgaagattctagcatccaggagaaagggagaatactgtgtatctgaacaattaaaataaaggctagaacacggggtgctgatgcgggatgagggaatggcagaagatgaggctggagaagaagaaaggaggcacatcactacgaacattttaagccataagatggacttcatatttcactctcagacaataggaagtcactgaatggctttaaaacctagggagacctctaagctttgggtgtttgaaagattatcttggtttaacttggagaatgaattgcagtcaggggcaatggaaccacagcaactgtattttgcctgttttattgttataggatctaggatgttgggaaggaacaaagaaattcaggcatctctcctgagaagagaaagggagtagaatgctccatcatgatgctaaccacaagaattgacttgacgggacagaatcaaggggaagaacgtcagtgaaacttctggtgacaatcacccacttaggtctttattttccatttttgcatttgtcatacttttcatagtaatgaaaacaaatatgttgtgtataatactggatgtcagcctatacatttggtttttaaatttggggaaggaaacttctttccactcgattgagcagtttcatctttgcaatgtatttattctttctgaacttttgggtagtgtcctcgtattagtctgttttcatgctgttgataaagacatacccaagactgggtaatttatacagaaaaagaggtttaatgggctcacagttccacatggctggggaagcctcacaatcatggcagaaggcaaaaggtctgtcttgtgtggcggaaggcaaaaggcccgtcttatgtggtggcagaaaagagagaatgagagccaagtgaaaagggaaatcccttataaaatcatcagattttgtgagacttattcactaccacgagaacagtatgggggaaactgtccctgtaattcaattatctcccaccaggtccctctcacaacacgtgggaattatgggaacttcaattcaagattatatttgagtggggacacagccaaatcatatcagtcctagaaaattcttcaggactggctctttttactttttggcaatttagccctcctggtcatgaacgagttgtcagattagcttctcctaatttcacactatgatggggagaaggaaatgcaggttttctgctcttaaaagattccacatactgtttggaccctcccgtgcatagtggagagaataactttattcattctgtgattatccagtaggaagtcttatcagacaggaggccctctggagggtcctagcaacactgacctaaacctcagagcactcgagtgaacacccaaagtcctctgtggagaaatgatgtagagtcttgaatgggaatatgttgctaatgggtcattagtaatttgagtgtcttttcagctggcgtcaaaacaggccctattcctcagtacccggtatcaagagaagacaactttcagaagcccattgcctagacttggaggaggctcttaatatgttttttttccacatttcataaattcttaggattttttaaatttaatatcctttatgaactaaggtcaacaaaactttaatcagtgaatatatttttggttctgagagttagaacactcctcccttttaaaacaaaaaagtttttagaattttgttgttaaatatatctggacatatgaagaaaactgaagttatcagccttttcaattgaatcctgacactgaaattgtcttttgaaacttacttttgtgtaactatcctggctcactggcactctgctctggaattaaatttccctaatttctgtcaactttttgaatctgcaacagtgggagcatatgatatgctgtatgagtaactgcacaagttattgttagaaaaattcctactgataagccctatgagttttatctgtaactgtgcaagtaacctaagtatcttgtggaattagaggcaatagtctgttttacaaagagtaggagagagagagaaagaggtagagacaaagaccaagaccaggagaggaagaaggagagagacagaaagggaggcagagggaagaaaggaaagaagaaagaaagaaaacattagcataattttccaagaataggcatctcagtgtcttgcctagaaatcaaggtcttcctctgctcagaagcacagaaactgtccaggaggggaagctctaagtaacgataacaatagaaactgattggcttgacaatgagataagaccaggtatgttcccggtgacccacagtgaaggaaaattcagtttttgcacagtttcactgtgtggagagaatatagcaccattacaaaacttcttttaaagaaaagacactttgggaattggcctcatctgtttttttgtaggcagttcagataggaataaaggaaagaagaaaacatctccttccttattccccatctgtttatctcactatttctcatcctccttacagacactcagctggaggttcacagatccagtttcttgtagattgctcctcaatgttgtgggtaattttaggcaaaatatgcaaatttcttgtttggcataaggtttttctttctcctgctaaaacaaaaatgtttccgctacaaaccatttaaatacttcgtagggattttgtcaggattaatgaggcaacagacagtcacaggtgattatacttatttcaagaatgcattattttagtatgtctatttggcattacattgattttttttcaggtcattagcttattaatttctactagacagcagagctgctgtgtcttgttatttttggagttaaaatggtgtaatattctcagagagctagacatcaacttagtgaactggaactggagaataatttattctttgctaccatagatgttaattatttaccacaagacagagctgggcaagaagaaatctcagaactttagtttggatacagactttgctttttatggtctgtttcaatccctttattttacagataagtagattaaaacaattatgattaagtatcttctcttatgtcacacagttgttattgattggtttatacttaggagctagagcaagtgttcccagggagtacattttgtactgaatatagctgtctttgtgaagagaaaaataacaagatttgtaggtactgaaagttacccagaaatctcacattagtctaggaagaggtatgtattatgatgctcagggttactgtggcttgatataattaaacagatgtatattcgtctcctagagtcttcaaaataatgatagtggtgacgatgacgatgatgatagttagcagtttttaaaggcttactctgcaacaggaattatacctagaggtttatacacattatctcatttatttcctaaaatgatgccatgaggttggatctattatttcttccagtctacagaagaagaacctgaagcttagagatatttggtaaattgttgcaacttcactctgtaagtaaatgtcagatctgaccaatatgatgccaccctatgccttgtcacagtattattctgctatacgtttgagaatctgccaaattttcttaggctcattatccactaccaccatattctgacttgtggtggaattaataatatttctagaagaaatatttgcaatatttaagcaaattttagaatttttatactagaaataagatcttggacataatgtaactgtatgtctaggtggtgctaagtaacgagactttctgcactgagttttagaatgaagaatgggaaggaaagctcttcctaaataaagcaggaaacatggataccagcttaccatttgtaaccagaggtgtttcttaatctttttcagatcagttgtacaaaagttaagacagcaataatggtttttatagaatgttctcatgacggttaaatattaagatgtatgtgaagtacatagcccagtactagaaagatctggcgtctcttctgattatttattgcctgtgctgtaccagttaatgtttggaatatcagtactgtattcaacagatatctatttgatatctagtatgtgattgggccagtaataggccctaaggggacagtactatttttatcttcatggtgctcactttctagttgaaggaggtagaaaaaataattattgcgggtagtgataagtgaaacaaaaataataagacaggattggggtagagtgacatgaattggggagaaggaaggattccatgagatcagttgtgaaaggaggcttctaagaaagcaacactggagttgagaagggaataagaaagagccaactacctggagattggtagaaggatgaaaagacatgcacaagatttgaagaagagtttatgaagatgaaggcttccaatgaactgagatttctacatcatggggagggtaataaaaatgctctttaaaatatgttaaacaaggtatctgtatctatgtctgcatgaaagtagagaggagacagaatagctgatgcaacagatgacagtgaataatcgagtatctacagcttctacaatgatcatcaaccaggttctttctgcccaactgcagcaagtcaatcactgagataatggattttgcaaaagagaagactattcatgaggcagccagtgaggaggtgaagaacaggtctcaactccacctcccagaagataaggcttagggatatttataggttatagaagtggggtcagctaagatgtgggaaaaggtgattgtcagtgggggaaaaatgaagcaatcagtgatctatgcaaacatagttgggatatgtggcatttcataggacacatttgcagaaaatgatggtattatgatctgagggtggaatttttggtcctctgatgtcaaaatgctctccggcatttacagaggcccagctgaagagtcaaccagtttgaactggtcaggagctgtcccacattcctgaaaaataactgaagtgaccattaccatggtgatttataaatgttcaatttattatgccgctaatgaaggttaagtttcagcgttcagtggtgcagccttcaattactgtggctttcagcttcatgaaaaaaaaaaaaaaaaaagaaaagaaaaagataaaaagcaggtaaccaaaagcaagcagggcatgctaaatttggcagacctaatcagatgaatcctctgtttcacagtgctattttgtttataatcttctttatccaggagaacattatttgaactaaaaagaacaaagcaagaatggtctgaaatcacaaggggttcagaagaatgaaacagatgatctggatacttttagaaggagtaataattattaatcccaacaaatgacattcttcagtgtctaagcattttcttttgtgattaaagagctgccgtgaacaaacctggaggagaacgtgatgggtaccagagaccagaaatttacacatggctatgttttcaaaggacaggtcaagatggtgagaggagtggggctaaggaagatgttatcatatataaattccagaaattgtactgaggtgacgttggtatccatctgcagcataattctatgcttaaatattgaaccaattatttttgagctcttagtaaggcaaggtggtggagccaggatgggttcaataagaagttctcatgctaaactaacctcttttttgataaaatttccagactttaaagtcaagaagacaaaacaattctagatttgagtagggcatatgaagaaaatatgtggcttaataacttgctttttaaagttaacattttgaaatgggatctaaaaaaaaatgtcgatcttacagaattagagagtagagcagtggttactgacaccggggagaaaatgagagattggggaggatgggagaggttggccaacaggtacaaagttacaagaagatagaaagaagttctggtgtccttttgcataatagggtgaagatagttaacagtaagggattgtatattataaaataccttgaagagaggttttggaatgttcttattacaaagaaatgaaaaatgcacaaggtgatgaatacgccagctaccctaatttgattattatacaacatatacatgtatcaaaacatcaaattgtatcccataaatatgtacaatacaatgtgtcaattaaaaaatagaaaacaatataattatgtggtctacaaagagaacataatggactaaatgttgattgggattcacagaatattgccaaaatattcgtgactttgctaaccatatgaaacaaaatgttcacatttaaatatataagttgatcttagttgtatttatgtaataattattatgatccataataaaccatacatattttgctaattttattatttctgtccatgacaagtgaagttattaataagatattataaaatttggcacataaattaaaatgtattcgttatcctattaacagtattattttaaatgacaaaactgtattccatatgtattccaatacaccaaaattttgtaagttaatttaccaatatccgttttttggacatttagattatttgcatttcttacacttttttgaagtattctagttatgtccttaggttaaattcctaaaagtaaaatttctgagctatgaggatatgccaaattaccttccaaaaatgtggtattcgccgggtgcagcggctcatgcttgtaatctcagtgctttggaaggctgaggtgagaggatggccttgaggcttggagttagagaccaggcatgggcaatgtaatgagactctgtctctacaaaaaaaaatttttaaattaactggacatgttgctgtgcacctctagttccagctacttgggaagctgagacaggatatctgcttgagcccaggagttcgtggctgcagagagctgtgatcacaccaccgcactccagccagggcaacagagtgagaccctgactccaaaagcaaaaacaaaagagcaaaaacgagattccaatgtatactcccaccaattaatttgaaggtgaccatatccctcctatcaaatactgtcactcatttacatctttgccaaatgtgggtaagaaaagaaataaatagtttttttatttaaatgtgtatatctttattgttagtgaggttgaatatttttcatatgcttattgatcacttatagtatttttatttggttatcaactcatttgcttatctgtttttaatatttttaaatattttcattttgtatgagaattattagagttatgacagaacacttacattatagaagtgcatcctgaaaaaattatgcattaaatgacatgatgtccggaattgtacgtaaagtcacctagtaatgcggtggagcctgatgaaacaagaatggctatgaaatgatataatgatggaagattggggaagggcttctagagtttcataatacatccctctccatttgtgtctacatataaaatatccattacaaaaggtagactaggtccttgtaaaaataattttatatgttgcaagcgcaggaagaaactttcagtttcaagagtttaagcatgtcaaattgtatacttcaactatgccattttatttgtaataacccaaaaccagaaacagcccaaatatccactaacagataaatgggtaaacaaatagtgataatatccatagaacagaatgcgactctgcaagaaaagaatgaactattcacataagcaacattaatgaatattaaaataattatgcagcatgaagaaaacaagaataataaaaaacactttataattaaaatcatataaaattccagaaaatattaactaatttattttgaaaaaaggtaaatcaagggttgcctggagggcaagtgagagtagggaaagattattagaaaggtatacaggagtaatggatatttggatatgtacattagcataattgtgacagtttcatgagtttatatgtatgtggaaagtacctcagttgtacaccggtttttgttttttgttttttttttttaaagagacagtgtctcactgtgttgcacaggctgtagtgcaaggctgtgatcatagctcactatagtgttgaactcctaggatcaagggattgtccccccgagtctctcaagcagctgggactaagggcatgctccaccacgtggagctaatatttttaaatatttttatagagatgaaggtcttggtatatcatccaggctgataatcaactcaactgtacacctgaaatatgtgtagtttatagcatgccaattatgtttcaatagaacgttaaaaatgacttaaagtctggatctactttttaaaggaaaacataaagtttggcaaccctatattgactccaccatgccttgggaaaggcagcccgcatcagtggcaggaaatattggtaagcaataaacatcatctctatatgagtcaacagaaatgttagaggggtgacaaaagccacagccctggactatgagatctctcatttctctattttcattttcttgactgtgcagcaatggccttgaggtcattacatgagtaaacaaaaccttatttgctctgacagttatgtcagttccaggaaaaacaccagcatggagtgcacccacccatgctcatagccttagccactgaaacacctatggagacactgcagaagaggtaccattctcgaccttgatgcagtctcctccagaccttattaatcacactcagtgtttctgcgccaattatggtttcagcctggcctcttaacaaatgacaccagaaacttgagttttggacatccaggcacatggttcctctgcagtgcctggagtcttctcaggggtgctaggagttatgtgacatcccccgagaaaaagggattcatccttctccccagagtcctacaggatgtcacaacaactttcccctcctcagggtgaactctgagcctacaaagaaatcctggcattcaggccacaaattaggatcacaaagtgaaatactctttcctaggtgggttttgacagcaaagcaaattagaccaaaattggaagaagagaaaattatttgcaaattgccggtaatacccaggctagagcaatcttcttagacaagattgggtcaggatcgtgccttaactagtcagagaggaaggaatgacattcccctaagggcacagactatttgtgattttctccagggaatgagagagagaacagaaacatctgctttcctttattacactgaggtgactaatacacactatggggaacctgtcaggtggtagaggtgaaatggcttatgccacagaaactggcagtgacctaaatctggcaagggtcctggcctgcgcaggttagaaagtacaacgcagctccttaaagcttcccacttacctggaatttgtggggaacctctccactgtggatgttcagatgtatggagttcgatgcctcctttacattcacagaggctttcctcctgagttgttatagtgaatatggaagcctttctccagcatgcactctccagtgttgattgagtccagggctttctgttgaagggatttcccatatttaccaaattcacagggctttgctccagtgtgaacgctctgtgattaactaaggatggagctctggctaaaggacatcctatattcaccatacacatgaggcctagctctagtgtgaattctctagtgttcaatgaagacagagctttggctaaagaaattctccacattcaccacactcataagtctttctccagcgtgaattatccagtgacaaatgagattggagttttggctaaataatttcccacatttgccacactcctaaggccttttctccattgtgaattccctgatgttgaacaagtttgtatttgtacctgaaagctttcctggttcactgcacttgtaatgactttttctgctgtgaaaggcctccccacatttggtgctgatgtgtggcttcaatccagttgtgagtggcctatgttggagaaggtacagttgccaggaaaatccttcccaactttcccacaggcgaaaggccttcctgacacttaaaatctgcagcctttcacagagaaagcattgtccacgtctctattccattgtgttccttctggtgctggtgcatgtttgcactaaaccagaattgtttcccacatgcctcacaagtgtactatttctgcccagatagcgttccttgttgctcagccagatacaaaatgtcccttaagaccagaacacacatctcacagggatgagccttctggatgaatggacctagctgtgacactttctactgaaacacttcactgagggtgtctgctttccctttgctccacaccaacaacctggcgaggttatataggcaaagttctctgcatcacggggcacagctctcaggctcatcaaggaaactccattcctctcagaagtcattaaaggtcggctatgttcataaagatcatactgagatggcttctctttctgtaggtggagcgagctgggacttgcaggtgaccaagaagggggatcccggaaccggaattgtctcccttggcgttccggaagtagaagcagagtcattgctgggtggcgccagccctcagacttgcctctttgcagtaggaagaaggcctccccacataccttcccacactcatcaccttaagccagactcggtgtccagtgaatatgaccatctcttgcccattttctaatgagtgttttcattaatgagttataagaatgtggtgggtaaatctatgggctttgaactagtgaatcaacttggtttcagaatctggcactgctacttactagtgaatttaagcaagttatttcacctttcagagtgtcagttccctcatgcatacaaggaagataaaaaataatgtatacaaaagtattggagtaattaatacatggagaactacatgtaaagcgtttagcatgatgtctgacatattaagcatccaatattagttgcttgcagaattattagtaaaagagattgcttctgaaagccattccaattcttaaattttataatgccacatttgaggtcacctgaagtacgtgtataacatgtgtacatttttgcgatttattttttcaattcccagattagaggcatagagatatcctagcaaggactccaagtgtgtagatctgtcaaagatatgaacatgaaagaacagcttatttcaataaacccactttacataccttgtgtgcttgtttttaacaataaaaattggaaagataattaaggaactgaaaaaccagagggtaaattctacagtttccttaatttaaagagtaattgtttttaattctgattcacctaagaagaaggcatttaacttgtagggctttctgtatttacatgtattatatattaaatcctcacaattgtttgcagtcattattattattattattattatgcccatataatatgttaatgtggaaactgaggctcacaaagcttaattaaattgcccaagttcctaaaattaataaatgtattttgggtttgaacctgtcttctgaccgcaaaattaatgatatttcaccacactgttttcattcagcctaacctagtcagccatgaccacatggtggtgtttaaagaaacaaaaaaatctgaagaactaaaacaaacttttaaaggtttaaatcgactttcactttgaaagaaatctagcctacctgtgccttaaaagataaaaaagtacaatagtaaaatggaaatcttttagagaaaagaattacataagctgattgtcaattaagactcctgaactggcctctgtactctggtttattaggagtgttgaataagtgcttttggacaacatttagatgtgaacatagtcttaaattctctttattcccattttttaaaaaaatgttcttgagagtattgcagtacaaattacatattgaccaaaattttgtcccttttgaaaatcaagtttatttttaagtttgaaaattcatacccatgatagtaaaagaaagagactattacaggagataagaagacgtagttcctaaaataggttatcagttaactagcatagggattttatgctgggaagttactaagcaaggaaatggcatgatatgccttagtgtgattttgaaataatcactctggctgctgtggaagaatgggtgtaaatggcaagagtggacaaaggaataccagttaaaaagttattgtaggccgggagcagtggctcatgcctgtaatcctagcactttgggaggccgaggcaggcggatcacgaggtcaggagatcgagaccatcctggctaacacggtgaaaccccatctctactaaaaatacaaaaaattaggcgagtgtggtggcgggcgcctgtagtcccagctactcagaagactgaggcaggagaatggcgtgaacccgggaggtggagcttgcagtgagccgagatctcaccactgttattgtagttgcctagcagaaacatacactacattgtagtaaaaatgacgatggaaggaagtagatagatatgagaaatatttatgattagataaaggactcacaaatatttttgaaatgagtgtggtgtcttggtgttggtgaggattactatggggtagaaagaaatattgaaaataaatcccagattattaaaatggggaaaatacaaatacctgtactctgttttccccatggatatgtggtagtccttggacatctgcacacttatcaagagatcttcatgtatttctgatccagttaataaaatggactggaaagcactgatctactgcctagcatggcaatggtgcccagtgcctggtcctctgtaaatgattcctcagacattactgaggaaagaatctctgagcttagagatatttcaataaaaaaaatttccaaaactgaaaagcagaggaaaaaaaaaagactacacaacaaaaaagagtacccaagaactgtgagacaacaacgaaaggtttaactacacataatgagaataccagaaggaaaagagagaaaggaagagaagaaatatttgaagcaaaaacaataatgactaagaatgttttctagactaatgtcagataccagactacaaatctaggtagctcagacagttgcaaaaaacaaaaagagagagggagagagaaaaaaaaaaccaaaagcaaaacaaaacaaaaaacccaaaacacaacaaaaactacacgtaggcatattatattcaaatttcagaacatcaaaaataaagaaaaaatttggaaaggagccagaggaaaaaacatcttacctatagaggagcaaagaattacatagtactttttctcagaaaccgtgcaagtaagaagagagtgaagtatttaaaatgtcacggaaaaaagcccaccaaattagaattctgtaccctacaaaattatcctttaaaagtgaagcagaaataaagactttctcagacaatcaaaaattcatggaatttgttgctagtagacctgctttgcaagacatgttaaagaagctctgtagagaaaagtacaattatataggtcagaaacttgaatctacataaagataggaagagaatgaaagaagaaataaatgaagatagaataaaaacttctatttttaattcctaattcatctaacagataacagtttgttcaaaataataatagcaacaatgtatttgtgtgtatatatacacatatatgtttacgtatgcttatgtataagtgtaatgaatgccagcaatgatatggataagagagaggaattggaattttttttattataaggtacttacactacccatgaagtggcatagagttatttgaaagtggactcaaattacttctaaatctctactggaaatttcatctagcaatcttgctctttggtatttatccaaagaatatgaaaacttatgcccacacaaaagcctgcatatagatgtttatggcagctttatgtaaatgctaaaacctggaaacaaccaagatgtctttcagcaggtcaatgaatgaataaactgtgatacagcagacaatggaatattaatcagtgctaaaaagaaatgagctgtggctgggtacggtggctcacgcctgtaatcccagcactttgggaggctgaggcaggtggattaccaagttaggagatcgagaccatcttggccaacatggtgaaaccccatctctaccaaaaatacaaaaattagctgggcgtggtggcacatgcctgtaatcccagctactcaggaggctgaggcaggagaatcgcttgaatcagggagtcggaggttgcagtgagctgagatcatgccagcctggcgacagagaaagactctgtctgaagaagaaagaaagaaagaaagaaagaaagaaagaaagaaagaaagaaagaaagaaaggaaggaaggaaggaaggaaggaaggaaggaaaagaaagaaagaaagaaacagggaggaaggaaggaaggaaggaaggagaaagaaaagaaaaggaaagaaaagagctgtgaagccattaaaagacggggggcggggaaccttaaatgtacatttctaagtgaagtaagccaatctgaaaagggtaccttggttccaactatgacattctggaaaaggtaaaactatggagacagaacaaagatctgtaattgcacacaagatgtttagggcagtgaaactattctgcttaaaactataacaacgaatacctgttattatacatttgtacaacatcacaaatattggctttgatatatttcctcgtgttgtacaacaagaggaaaccctaatataaactatggactttggttaataatgacatggccatgtagattaatcagtcttaacaaacgtaccactggtgagggatgttgatagttggggaggccgtgcatgtgtgatggcagtgagtatatacaaaatatctgtaccttctgctctcaatctgtctctctctctctttttttttttctgtgaaccaatgctccaaaaaatagtctgttaaagaaagagcaactaaaacaagctcctttcatcacattgttttatctctctgattattactggtgaatacctccctagcaccctagaatgtatctgtcgttctattgattttgttcccaaagttctgttcttttccctaacagataaacagcagagaagctatgccaccagtacctccagtcatcttctagctttttctgtaagatttcaccctaagcaatgaatcaaaagtctacttccaaatctttttcatgttctgttaatttcaaataagtccactattttctttgaacataattgaatttcttggttaattaagaatacgtaataaaacagttggtaattatttaagatatggtgacaaacagttaaatcaatatttgtccaaagcattctgctttaaaactaatttttcaataaattttcagatatattagtatgttttaacttttacctttagttggacattcatcattgaaaatacattattgtaatctttttgaggctcttaaagtttagatctgtagatctttggcaattctacttcttctctgtcagccctctcttgacttttctctattcattcttttccagatttcacaaccctttatttgcatcactttcttgtcaataatgtcaatgtcatgatgttactgttgtatccacatggatgaatctatctaacttgtgtattttcaagttcatgctattagggagttatgagagcaaataataaactacaaaaataaatgtggccctcttcactctcatgacctactgtagcaaattcaagcatttccactctcttctaacctccccgtcactaaactatcttcttccctgtgagtaggagacattttactttacctaaaagtataaagtgtaaattcctttaattactgttaacacacccatgactacttcccttttgcttgcttccagatcatgctaacaatgtcgcttctttgccgtaactatagatctttctatttttacttcaaaatctagttcttttcctcttcattggaatactacttcacaatttatctgcttgatttttatgttattttcagtttcttttccttttctataatagcatcaatccaatagcattgtattagtatgttctcacactcctataaatacttgagatggttaatttataaaggaaaggtttaattgactcacagttccatatggctggggaggtctcaggaaacttacaatcatggcagaagaggaagaggcacatcttacatggcagcaggtgagagagaggggcaagcaaagggggaagaccccttataaaaccatcagatcttgtgagaactcactcactattgggggaacagcatgggggaaatgggggaaacctccatcatgatccaataacctcctaccagatctctcccttgacacatggggattgcaatttgagatgagatttgggtggggacacaaagtcaaatgatatgaggcaggtaaatatttgaattttcttttctcttgaattaaaaaaaatgaaaatgaaagaaaaaaatcccttgttcttgtattaggcacttcattttgatgttggtgtatatttgttgtctcaaattcatcacatgggttgactctgtgtgccaacccaaatctcatcttgaattttgataatccccacatgtcaaggatgggaccaagtagataattgaatcacgggggtggttttccccatactattctcatgatagtgagtgagttctcatgagatctaatgtttcttaaggggcttcctccttcacttgactctcacttctcttgccttccaccgtgtaaaatgtgcctttccttgtcctttgccttccaccatgattgtgaggcctcctcagccatgtggaactgtgagtctattaaatctctttttccttatcaattacccaatcttgggtatgtctttttttagcagcataagaacagactaatacagtaaattggtactggatagtggggcgcttctgtaaagatacccataaatgtggaagcgactttggaactgggtaataagcagaagttggaacagttcggaaggctcagaagaaaggaatatgtgggaaagtttggaacttcctaaagatttgttgaatggctttgacaaaaatgctaacagtgatatggacaataaaatccaggctgaggtgttctcagatggagatgggaaacttgttgggaactgaagcaaagctcactgtttgcaaagagactaatgacatttggccctgacctagagatctgtggaaatttgaacttgagagagataatttaggatatctggcagacgaaatttctaagtggcaaagtgttcaagaggaagcagagcataaaagtttgaaatctttgcagcctgatgatgcagtagaaaagaaaaaccaattatctggggagaaattcaagctggcagcagagatttgtataagtaattaggaacccaatgttaattacccagataatggggaaaatgtctccggggcatgtaagagaccttcacagcagcccctcctatcacagacctggaggcctaggagggaaaagtggtttcctgggccttgtccagggcccccctgctgtttgcaacctcaggacttggtgtcctgcatcccaacagctatagctgtgactataagagttgaaggtatagctcagggccattgcttcagacggtgcaagccccaatccttggtagctaacaagtgatgttgggcttgctgctgtacataaatcaagaattgatgtttgggaacctctggctaggtttcaaaggatgtatggaaaggcctggctgtccaggtagaaatctgctgcaggggtgaagccctgatggagaacctctgctaggagagtgtggaagggaaatatggggtcagagcacccacacagtgtccccactggggcactgcctagtggagctgtgagaagagggccaccatcctgcagaccctggaatggtagatccaccgacagcttgcaccgtgtgcctggaaaagccacagacactcaacaccagctcatgaaagcagctgggggagggggagaggtactgtaccttgtaaagccacaggggcagagctgtccaaggccataggagtccacctcttgcatccatgtgacctggatctgagacatagagtcaaaggtgatcatttcagagctttaagatttgactgccttactggattttggactttcatggggccagtagcccctttgttttggccaatttctcccatttggaatggctgtatttacccagtgcttgtacccccattgtatctgggaagtaacatcattcaaataattgaatcatgggggcagtttccaccatatggttctcacgatagtgagtgacttcttaggagatctgatggttttataaatgggagttcacctgcacaagctctcttcttgcctgccaccatgtaagacatgcctttgctcctcctttgccttccgtcatgatcatgaggcctccctagccatgtggaactgtgagaccattaaacctctttttctttatcaattacccagtcttgggtatgtgtgtctgtattagcagaataagaactaatacacataccactcattcttcaataaattaaaatttcttttcccttcacttgttttttattgactgctttcctcacttctttttgatatatcccaaccactagaaataatttactttctatttctaaagtattccacttcttaggacattatggaccctttaaatttttttgaataaataaatggatgatgaatatcaatggatgttggatgataggcactggagggaaggagaggaaatggtaccaccttagcttttctcttaagataatagcaatattcatcatgcactgtccaagtacacacatacacattgtagtcattgtcatttctacttcgctttaacatttgacactctttatctttacttctcgaaccattttcctgcctttagtttcatgcttctgcattctgtttcttgccccccagtttttagcctttttagggttctctgcaaggtcctcttctgttaacctattggtgttgacttctgtcaattccttctaggactttaacacaggctctcttatgttcacagtctacatcacatacactccctcaataagtatatttactcccatggcatcagttcttatgcttacattccatttatagttatcactttgcctttttcgcctctaactacccatctctagctgtcatggaatcaggtctcactcctgtattccatatctctgtgagttgtggcactatatccccactttcccaagtcagagaccatggtgatattctcactcttccttcatcttttctttttcttactgatgattcttcttatcaagtctattctgactctgcagtatcttcagactgacaataaaagcaatagttttatggacagtttctactaacaaataaccttaaacttacccattatagtagaaataatagtactgtatgataattgtctgttcatttgtccctttcacttgaaaaagtataaactccttaatggtagaaagtatgtgatagtctttgttatattccaagctcctcaaacatttattggaagttagtgtgtaataaaacaatttcttcagttagacatttgagataaattttaattttgagtaatgtaataatttcaatatttttgagtttaatagtgttgagtacacagtggctgaaattatatattggggcaatatgttaaagttttaccttgattgaggaaatagtttagataatatacattagtcaaaaaatatatgacttgagtacaatctattaataaatgcacgtggtaaagatttacatataatcatcaaattaatactagtagtacgaataaatatgaaacccttccttgtgtgcatacactttaaacattagcagacatggggtatggctgcagataaccagaaaactatgtttgaaagtagggaagataccctagggagatacttgtcttgccaagtaatgatattggcaatgtgtcagaaatgtaaacactataagaaattccaactacagcttggccaaattaatctcaacttgctgatgttcagaattttttaatactctaatggcagttgtaaagtttgtgaaagaatttaacattgctcagtaacttgaaacagaatcacagcccttaaacataatttatttttcaacacatttttttaaataggttttttagaggagttttagttttatggaaaaattgagcagaaagtacaaaaagttattttggctctctcctcttctactttctctcctcctgctcttactaatatcttacaccagtatggcacattctttacagttgatgatccaatattagtacactattattaactgagggtcatagtttacactagaacccattcattgtgttgcacagttctatgggttttgacaaatgcataatgtcatctaactaccattatagtaccatacaaaatagtctcacttcttggtatggtttggctgtgtccccaccaaaaatctcatcttgaattgttgcgggggtccatcccgcagaccctgacccaacgatggatgaataatatacactgacccagatattatgcttatcagtttggctgagggtctgggctgctcacagactccaaggagagtgctgtaaagagttgcaactgggcccctactagctggccctcctggcatttattcagcacacattaaatgataaaattctcaagtaaacactactagaaggtaattaccattgctaatccccaagtagagagcaatcatgcaaatgtggatggtcaaaagttagtcttatgaccaatgagtaaacaagctatttagatagactcttctacattcctatgttaattacccttgctatagtcagaggattaggctgccttcagccataactctatcctgaggcttttgcaaaaaccttccagtcttccaagaaggtttgtatttattttaaaatttctcccactatcctgactgaacccctataaattatagctcccataattcctaagtgttgtgggagggacctggtgggatataattgaatcattgggtcggtttcccccatattgttctgatggtagtaagccatcatgagatctgatgattttataaggggaaaccccttttgcttggctttcattttcttgtctgccaccatgtaagacgtgactttcaccttctgccatgattgtgaggcctccgcagccacatggaactgggagtccattaaacctctttttctttataaattacccagtggtagatatgtctttattagcagcatgagaacagactaaaacactgcttctaaaacatcctatgctccacccttttatccctctcttcctttgcccaaatcctagcaatcactgatttttttaactacctatagttttgccttttccagactgtcattgtggagactaaagctactccatcttggatgctaatccaccgtgttgacttctgaataacactagttctggaatgcctctaagatttctattttacctactattccttatgtaagagcatgtacttactgtaaatcctcccttaggtcaaaacaaacttgatgttatcatatttaccataaatcctgcccttaagcaatcggacacatcccttctgtaacacacataccctttccctgtggcatattatacaagccctgggcagtgtgggaatccaccatctcatcttgtggctgcttgagacatggcttctgttcttaagtccctattaaatgtttctttctgagaaactggatttatcggcctatttctttggtctctcagcttcctttgccttcgtgggtaggtttgcatagacctgctcactgcagaacagtcatatactatatatcctttttgactggtttctttcacttagccatatgtatcaacacttaatgaatgcttaaaatgtacacagcagtgagctagaagttggagaaataagaatttactcctttaatgagtccgttatttaatagggctggcagatatgtaaataaataaataaattacaatagagttgtgtccggagtttgttccttccagggggtttgtggtcttgctgacttcaagaatgaagccgtggacttttgcagtgttacaactcttaaaggtggcacggtcccaaagagtgagcagcaacaacatttattgtgaagagcgaaagaacaaagcttgcaagtgtggaaggggacctgagcaggttgcccctgctggctggggtggccagcttttattcccttattcatcccctcccacgtcctgctgattggtccattttacagagcactgattggtccattttacagggtgctgattggtccattttacagggtgctgattggtccattttataaacctctagttagccacagaaggctgattggtgcatttttacagagcactgattggtgtattttacaaatcagagtgctgattggtgcattttacaatcctcttgtaagaaagctctccaagtccctactcgacccaagaagtccagctggcttcacctctcagagtgaagtaagtataagagtcttaataaaaaaatatagatggtaggccaggtgctgtgtctcacgcctgtaatcccagcactttgggagaccgaaacgggtggatcatgacgtcaggagttcaagatcagcctggctaagttgctgaaaccccgtctctactaaaaatacaaaaattagctgggcttggtgacacgtacctctaatccgagctactcgggaggctgaggcaggagaatcgcttgaacccggatggcagaggttgcagttagccaagatcatgccactgcactctagcctggacgacagagcaagattcagtctcaaaaaatatatatatatgtatatatagagagagagatagtagaaaactatctatagatggtatacatgggggcaaatggtgggttgtttggttaaccgtcccagaagaaatgatttctaagctggattctgagagatagatatggttttgccagaacagaggtgtcatccttctctagtttctatattttcacatttccatgggccatttatactaaatgcatttcataaatatagcccttttaatatgtcttgatgttctagtattattaggttggtgcaaaagtaattgcagttttttgctaatatattggctatacgttctgggcacatgacaaatagaattaagcgaacacaatgtaaaaatcttgcactgcatatgcaaatagtgatgttattgacccaatctgcttatactttgacttgtttttctgtcagtgatgacaggtttgtgaccaatatgggtggaattaagagtgttgtcagagcctataaaagaaactcatctgctgttacatgctgaacctaaccatatgactttaagttctatgtcagaataaactcccaaaatggtttaaagattgctattcaaacataaatatatacatacatacatatatatatatatatacacacgatatatctcaacaaatattgctgggtttttcctttaagtaaatttttattctgacacaatttgtaccttaaaatgattatagataatttgaagttttgttttttacatttctgtgctcccaagtatattttgggtatctgtaattatgaatgcgaattggatgaaaacactcaatatttgttggatgaaagcataagtatgggactgataatgcagaaattaaagatgtaaaactcaatatcacactgagatatttttagaacacatttatttcttttttaaaagatatccagatagttgccaaacatttacatctatagttccttatttatgccttctaatttagaccaatagtatggatcattacaagtaattttgaaaacatgaggggtcttatcattaacctgtcactttaggtagctgaagttgggttattgtgcataatcatctcacaaagaagtttgcaaatcatggacatagctttaattggctatttgcctcagctcttctgaaagactcaacctttagtcatgttttaaataaaaaagaaaatacagtgtggctcaagttatttcctgtacttaaaacatttggcaaaaatgagtttcagggttgttaaaactgatgtgttcaaatttggcagcctcttttgtcctcagggtacattgtaacatctgctattccacagtgtatacactaatcacgagaagccttgctttagtattgttttttttttaatccttaaatatatacgaaaagcaaagcttacaacaatgttttaggatgaatgatactataaaattctattagcctactttgggaaaacacatgtttttcttttgaattatgtccaaaacatatgaattgaacacctgtacaaaaattttatgcaaagaccatgaaataaataaatttcctaaactgcaccattgaggaagacttgtgatgaccttaattctcattggcatgcctatagcagcagtcttattatttcatcccagacctgggggcattttttggtgtctcttagatgggaaatattaacttcatgaagcacagatagacagagtgagcccttgtagaagcagtttctgtgattacaaaacaaacagggattctagtctcaatgaactgtatgttcaagggaaatgacaggccactgacttgctaactaaaaagtcttggattaaaagcaacctatctcatacaccaggaaacaagtacatgtgctttaacccaatcatctcagcagccctctgtgtatgggggtgattgtgtttttttgtgtgtgtatgtgtgtgtgtgtgtgcatgtgcccatgtatgtgatattaatgaaacagagaggtgaagccagctagactccctggatcgagaggggacttggagaacttttctgtcttacaagaggattgtaaaatgcaccaatcagcactctgtagttaggattgtaaaacgcaccaatcagcgctctgtggctagctagaggtttgtaaaatggaccaatcagcaggacgtgggcagggacaaataagggaataaaagctggccaccccagccagcaggggcaacctgctcaggtccccttccacactgtgcaagctttgttcttttgctcttcacattaaatcttgctgctgctcactctttgggtccatgccatctttaagagctgtaacactcaccgcgaaggtccgcggctccattcttgaagtcagcaagaccacgaacccaccagaaggaaccagctacggacacaaaacttcatataagtaagatttcaggtgcgtaatttgctaagtgttttatatgtatgtaaacagttgaacaattttaaaaataaatttaatttttaaaagtagtattagatttacagaagggttatgatagcagagtttccacatacttggcaccctgttcctctgttattagcatcttatttgttacaattagtatgatatatttgttataattattgtaccagtattcacccactattgttaatgaagttcgtatgttattcagatttccttagtttttacttaatgtccttcttctgttccaagatcccatccaaggtaatacatttagttgtcacatttaggctcctcttagctgtgacaacatgtaagactttccttgttttttatgtcctggacaggtttgaggaatactggtcaagtgttttgcataatttcttcattaatcactctcttgaaaaattacttagccagtgaataaatttattttttgtctaaggtttagggatccaaaaagtgacactaattaccttgagatgaaatcaatatacccattgctaaatctcaccagcaagaagcttccttgatatagaagactggatatttttccatgattcctgctgtaagaaacaatatcctggcagttgttatgaacctttttcaaaaatacatttttatgcagatgacctcgcaaactgcaaaagtcttgggatgatctaagtgactgtagagacagttctgggcctttcagctggtaactttcaggtgtaattaggggctgttctgaatcgaaagtgtggctgttaaggacttctctcatgtgatggaaacactgagttataaccagtagtaggaaatgtagtgtgtgtacctgtgttttttccagcagaatatttttatttatttgacaaatatccattgagcctccattctatgtcagatacttgtctagttgcactgaaaacttagttcctgagccatgttcatgtctttgttctgtgagtccccagcttccctgttccctattttctgagtttcccagtaaaccattgaagaatgcttcttaaagaaataaacttgaattgaccttaaattataaacaagttggatcagaagtaaatatttctaaactgtaaataaaggaagttaattactatacaaagctaactttgtacctggattacgccctacagtgtaatgcatgatgtggtaacttgtgattacaaatgtagatcattaaattgggagcagaggttacatattaggtggcattgcttttttttctctatctccaagtcatttgctttttaaatgttttgccaataaagatttcactattttgtaagtcagctaatatttttagttccatagttttagcaggtagattgcacccgtattgatgtcttatgcaatcagtaaaaactgtccacaaataaaaagaaaaaaatgtaagggttctgtatacaagtttttaaaaaacttatgcttgtcatgccatttagttttattttgtaaattccaagaattaattgatgtactttttatatcatgtcttttgttggatatgaaaatcagttatttcagtctctcgttagaaataggtacaaaatatcttgtgtcttcagtacatggaaagcaaagggaaaatttttctgttaccttgggtatctttgtacctttaaaagatatcatgtactccaaggttaattaattagagtatcttggaaataatatcacttaaatatacaacatcaatataaaatcaataaaacattagctcttgattttgaaaatgtctacatattaaaaataaataaattctgcagaagtccaacaggttttcttttctttttttgttttgttttgttttttaggattttctttttgagacagggtctctctttgtcaccgaggctggagtgcagaggcgctgtcttggctcattgcaacctccgcctcccagactcaggtgattcttccgtcacagcctcccaagtagctaggaccacaggtttgcaccaccacacccagctaatttttgtatttttcttttagagatggggttttgccgtactaattataacaaccaggctggtctccaactcccagcctcaagcaatccacccccttggcctcccaaagtgctgggattacaggcgtgagccaccacactggcccccaagcaggtttttgttgtgttttgttttattaaaattagaaatgttgtggcatcctgtggaaagatctcaaattaaatcctgcctagtttggagtgtgtctgtaaagatagaaaatcatcattaacacgtcagaaacctaaatagaagttcacaaattaaatgttctttggaattaggtatgtggaagaggagagctcaagtcctctacttcccagccatctgatatttttccttcttatgggaagagggaatattgatacatttatgtgctcagttcttatgtacattatgccaaaggttttattatcttttattataagatatctgcatatagacactaagaaaggatacatatattggtagattctctcaattagagttcttctgctcagggaccatgctagctcattctgactcttcgcaaagtgtttagggaatgacttgtcccccctttttaaagattcacttaggacttttcagacacttaaattttctccctttgaaaagaaggttggaagcaatgtggataaaatataatattcatagagcattgtatttataaatatgtactaggaaatgaatgagcaggtaaaagccattggccagtttccttctctcagtctcatgaaagtactatcttgttgagattaagataaaattttgtctaactcagacatgagatatgcgagcttctaattctgtgtacctcccattaataacatatgtttttagagctcaatcaaccacagaaagaaagaaggaaacaagaaaaaaatctaataggtttcttcccttattctgatgctggtaagctgtaaaatgagggaaatcctgatgttggccctaagctgtaagaaagagtagttaataataatagcctattgtgttagcttgctagggttgcactaataaactgccataaattggacagcttgaaacaactgaattttattgtctcacagttctggtggttgcaagtctgaaatcaagttctcagcaggaccacattccctccgaaacctggattaaacccttccctacctctcctaacttccagtggtttgctgacaacttttggtggtccttgacttacaactgcataactccaatccctaactttgaggccgcatggcattctccctgtgttgttttcacatggccatcttcttataaggacaatgatcacgctggattaggagcccaccctactgtagtatgaactcatctaagcttagctagttacatttgcgatgaccttatttcttaataacataagcataggtactgcaagttagaaactcaaacatattttttggggtggaaggaacataattcaactgacaacatttgtttatttttttggccaggtgtacattacatggccacgatttgctctgagaagtggggttacatttacattggtgatacttgttcaacaaatctgagcaggcaatgtctagagataccaagaagaggagcttcctgtctttattagtgggttagaatctagttgaggaaacagaccattttaaattgttttatgtaaagtgataatttctgtcatggcaatagggacaaagtactatgaaaaaggttgatggagtgataaatttttcttggcttgaagtgatttttattttctttatgctttaatgttttctgagttttctacaatgagagtttactagttcgaggagacattcttgcacagggaatagacaaaagaatataatttgaggcatttaagataaaggccagaaaccagctatccactgccatggagaaagagattgtatagaaatgttttctgggctgggcacggtggctcacacctctattctcaacactttgggatgctgaagcaggcagattgcttgaggcctgaagttcgagaccagcctggccaacatggtgaaaccttgtctttaccaaaaataaaaaaaaatcagccaggcatagtggtgagtgcctgtagtcccagctactcgggaggctgaagtgggaggattgcttgagcccaggaggcagaggttgcagtgagctgagattgtgccactgtgccgggtgacagagtgagactcctcaaaataaataaataaataaaaattaagaagtagtaaatctcatatttctggtttcaaaactcttttaccctcttaaaaacaatgaaggacttcaaagaacttttgttattgtgggttatatctacaatgtttacctcagatctgatcttactcttctaatttcatcgttcaactcaggttcctctttactgtgccctgggaccaaggtaagcaggcacaaaggaatggcttctgaaacatgtagacgagcataggcacataccagcatatgctttcaataatgaggaagaagaaaacgaatataacggctgagaagcttccaatataccaccaaatccggactctggagactcccaagcagactgtaaaagctgattgcctcaaagtgtcaaaatccaaatctaaaatcatatcctgtcctttcttctggcacctatcaagatgattctgaggggtttataagtttcttataataacctatttcatagtatggaaaagttgtcatgaaactcctgtttgttacctcattatggtgtccttgtttcttgtttagcaatagcctaaacaggctctgcgggatgctcagaaaatggttacatgggtgtagctacaagcaaaacaggaatgcagagaaaagaactaacaggccctgctggtttctcagatgcagtgctgcatattccaagaggccttcattaggagacaggcattaggaggggttgattgcaggccaatcaactagctgcagtttcaaggctgcttccagcttactcgtctgtttgaataagttgaagtaaatttagctacaaggagactccacttctatttaatcaaatagtcttaatgcagtaaggaatcttagtgcaacaaaccatcaccatcctaatgcgatcaccttgtaagattcctcatctagtgtttgaatcccttggggggcaacccccattattgctaaccaggtttcctttaacatcttcagtaatttaaatttcactgccaacaccagcgaacctgctcttttattgaataactcgaactgttatgaagttgttatactgagcagcaaagtatttactaaatagaaaatgccctactgttctaattctatcccttggtatgacattaaaaaaaaactccagtccctttttctcatgtgattccttcaaacatttcaaagcaaccagagtattttgcccaaatagtcttgttttcattacagctatgtatagtttgttcatcacatggtttcaagtctctttacaatctttgtcatttttccctggacgtatttggaactaaacgttatcccagagttgaatacaaaattctgtgtctgtgtaccaaaaaattgtacattcctatggcatttacagttacaaaaaagttttaagtattttttcagatactctgttatcttacctttttctctgtagtatactatttgggaacagtaagttccaaagcgctttttgggacagtaactttttagggaacaattcttctttttttactcaatttttgaattttactcctaaacctgtgaaatctagtagtggatacaatatcacaacccaagggtaattctggatctctaatttttcattcaaaaactggtctatcttaagcagcttataggaattcttttttcttttgattttgaaagtgattcacttcacacaggtagctttgcttaggtttatggctggtgttctgatttcttgatgcccatgccataccagtagttacatattttgaatgtcactcattcctgatcttcaatatatgtcaaagggatggaacatatattgaggaatagatctaatgtaaaatattagaatagtacatgtatatgtactcctctaaaatgctagagaaaataaacttataaatgttatattgcctataatatgcacattaaggaaagacttattctttgaattggccaatttatctatttttatatgttgatagttatgaaagttaaatgttttctaccctccggaagtacacctgtgtgattttttttttttttttaagttaatctcctttaagcaaaatgtgtttggtatttggaatgttgggtcctttctgtggaggttgtttaaaatgtaaaataatccattgttctcagctaaaatagttctctgttactatcttcttgcgatctttgtccttcatgcagttttaaatccggatgcatagttttcctgccagaagttaatgcttacttctcatttgttttcttttcctgttgccttcagagctcacagagagaagatgctatttctgcaatctctaagacatgtggctttcccaggcagattgtttatttaatgaaaaagaagagaggtccactctatttgtttggagttatgtaaatattctttaaaaggaggatttcctcatttattccacttcagtcttcctgttcagagagagctttaaatgcaccttaaatcactatatgatgacagcttgagttacagttttataacagtaccaaatatattcaagacgttgtgaataagaaaggaaaaatggattaattcctaatttatctctctatatattacaatataagattattgcatatcttcacgtataaaaccagtttatcattataaacctagtaataaaaataacacatagtgctatgataataggtaagtttgaatagaaggtatcaaaaaggagacagataaggtattgttctatacatttagtactaatagttttgtttctttttttatttcacattcttactcaggtagagtttgctcaccatgttgtaattgaagttggaaaactctttaaaaggtaccataatagaaggatgttttcaatcggaaacagtatattttttatttctcttttcatcatcttgtgagttgagttttaaattaaacatagaattcagataacaccatgaataaaccttaaagcatttcacattttgcaaatataattatttctcaaatatgtaaccagaatgggcatatggtaggtactacagagagaaaagggtaacaatgattaaaatatcattaaaaataatattgtggaatgttaatatttaatataacaaatgtttacacatataattatacataatatatacatatgttttacatgcactacatataacacatataatgtatatttcacataacatgttacaaataatcttatatatgtaatttaaatatatttatatatttataaatataaatacactgtcaagggttggaattacattagagctttttcattttatgtagtgaatactcatagatcaggtacagatattttttctcagaacatttttagactgtattaaatattatagtataaaattggtgaagtgaagccatcaaaatgactataccagctcttttataactacttttaaaaaggcaaatattagtatataattttatccaaagcataatatctatggacgtagatgacctgtttaaggagaaaagaaacatgttcaaatcacattgaaataacagagagaaatgtcagggtttcagtgttacgtgagggaaacattatgtttcctccaaataataataagttgccaggtattttatcatagtttcttgaaattgacacagacctttaggtctgttgtgcatcgtacgtaattttcttgtttggcgttgcactgattttaaaagttctgcaataaagcacattaattgcattgttttcttttcatttagaatttcagacattatttccagaaaagtcatagtttgaagcgcttcaaaatctttgaacttagaaaaggaaaggaagttcctttatgtcaaaactgtgataaaagcaaacaaacatttaataaatgttggatagacttaaatagttttgtgttcatctcaagcatacattgaaagcttattaaactgtattaacttgtgtaataaatgttataaaagaatcagagttctggaagattcttgtttcctttaggcagaaccacatttgaagcaaactgaagtgagagaaagcatgattgtgcaaaagagcttagagttttatacaccctctcaacaactcttcctattagtctcacctgtactgccaggtcattcatgcttccttttcatttgtcttcttttgtcactgtaagttaagccaagtaattgctgcctctgctgtcctcaggttgaaacagagttaaattagctcacctctatgtgtgccagatgttcctttggtcaaggtggctggttctctctgtttctgtaggtaaagaattgtaattgcttgagcttctagccattgttcttttttatcaaacctttcgtcaccatgaagatttccttctgtgccttttgcagtcatccacagctttcacaaacgagggctaattatcactgatgtgactgactgccattatttcctagttataattttctcaatacaatttctcttcacaactcctcttaggatacttttgagctatttccacttattagtttaacaattttgtaacttctttctttgtatttcctaatgtagaaacataggtggattgaaacccacgtttccaaggaataaagctaagagtgtgtttaaagagaaggctcatatgtattactgagcttctctactgttagagtatatagaagatagtctcttctttattttgcaaatacgacaactgaatcacagggcattcattactttagtaaacctctacttagcaaaatctttacaacttactgctattaacaattagagtattggtaatactgagtgatgtaattattgctatacaggtgatttcagagcctggttaacacagaaatctaaatctcagatctaacttatttcattccaaggttagggagggaattttgcttagatttcctgctcccagtgaatcttgagtggtgtccaatagttctaagccatggacactgggtttaagtcactatgggaattcctcattgattggttccactgaattggtaaatacagttattcacatctcagttaggtggtatgttctgcagttagcttatagggcaaaatcccacatattaaaaattccatgccccacatccctccctcccctaccatcacatcctacactagagtgatacatttgttacaatccatgaaccaacactgacacattgttatcacccaaagtccatagtttacatgagagttcactctgtgttgtacattccataagttttgacaaatgtgtaatggcagatattcatccttatagtaacatacagaatagtttcacttccctaaaagtgacctgtgctctacctgcttatttgtatgtctctctatttttcccacaccctggcaaccatgtattcttttactgcctccatggttttgccttttccaaaatgtataaacgtggaatcatatggtatgtagcctttccaaactgtctgttttcacttaataatatgcttttcatgttcttccgtgtcttttcatggcttggaaaatgatactacttttgagtcagaaaattttaaggagcacttaaaagcaatgtttttgtttcatcctgaaaagagaagaaaatatgctttttgagtagaaattttatatattatttgaagattccctgcttcccacatagaatgtggtcaggagcatgtgaaaactattacagatcacttaatgtggaagttaaataatataaaaagtaatgaaaactagattatcaattctgatctatgttcattaagaagcatgaactattaacaagtatgtagatagtttttactgttgctcaacccttgtaagctacaaataagaaccaactgtatcttacagaattgaattgagtgaaacttaacattatagtgccccaaaaaagagaaaggtttaaacgtaatttttgtctaaacttatccaattataaatattctttcattctaatttaattaaaatgaaggtagaccttgatgtgatatacaacttcagcaaagtttcaggttacaaaaccaatgtacaaaaatcacttgtattcctgtgcaccaacaacatcaagctgagagccaaatgaagaaagaaatctcattcctaatagccacaaaaagaataaaatacctaggaatacagctaaccaaggaggtgaaagacctctgcaatgaatataaaacgttgagtgaaatcaatgatgacacaaacaaatggaaaaacattccaggctcatgaataggaagaaccaatattatcaaaatggccatactgcccaaaacagcattacttcggtgctattcctatcaaattaccaatgacattcttcatgaaattagaaaaaactatttttgaattcatatggaaccaaaaaagagctcagatagccaaggcaattctaagcaaacactggaggcctcacgttacctgacttcaaattgttctacaaggctcagtaatgaaaacagcatggtactggtacaaaaacagacacatagaccaatggaacagaacagagagcccagaaataatgccatatacctacaaccatttgatcattgacaaaatccacaaaacaagcaatagggcaaggattctctattcaataaatggtgctgggataactggctgaccatatgcagaagattgaaactggacactttccttacaccaaatataaaaattaagatggattaaaaactaaaaccaaaggctaacatcaaaaactacaacaaccctggaagataacctagaaaatactattctggacataggacttggcaaagacttcataacaaagacaccaaaagcaattgcaacaaaaacaaaaattgacaaatgggacctaattaaagagcctctgcacaacaaaataaactatcaaaaatgtaaacagacgatctacagaatggaagaaaatatcttcaaactatgcatctgacaaaggcctaatatccagagtctatgagaaacttaaatttacaagcaaaaaacaacgccattaaaaagtgggccaaggacatgaacagacacttttcaaaagaagacattcatgcagccaagaagcatatgagaaaatgctcaacatccttatcattaaataaatgcaattcaaaactgcaatgagatacttttcacaccaatcagaatggctattattaaaaagtcaaaaaataacatgttggtgaggttgtagagaaaagagaatgcttatacactgctggtggaaatgtaaactacttcagttattgtgaaaagcagttcggtagtttctaaaagaacttaaaatagaagtaccatttgagccagcaatctcattgttgggtatacacccaaagaaatataagttgttctaccacaaaggcacatgcacatgtacgttcattgcagcactattcacaatagcaaagacatgcaacaacctaaatgtccatcaaaggtagactggataaaaaatgttgtacatacaccatagaataccatgtaaccataaaaaaagaattagatcatgtgctttgcagcaacatggatggagctggaggccattatcctaagcaaactgatggaggaacagaaaaccaaatacctcatattctcacttgtaagtggaagctaaacactgagtacacacagacacaaagaagggaacaacagacatgggggcctacttgagggtggagggtggcaggagggtgaagtttgaaaaactacctatcgggtaccatgtttattacctgggtgacaaaataagttgtacactagaccaccatgacacacgatttacctacatagcaaacatgtacacatacccctgaacctaaaataaaagcttaaaataaaaaacaaaataaaataaaatacaaggtatagaatagggtagtcattggaagttcatgattaaataaatataactgtggtgggaggatcacgacggaaaataattttattttatttttctgtgctttaaatcttatgtcctatggtttgttaataaaaatcatggactctcaaaagtttaaaggaacttaaaatgtcttcaaaattgaggaactgtatatattttatactttttgactatttcttctttcagctggttgttttggcatagatattaactctgatatttatctaagaagagctgctattattgattctatgttatagaatatgttttcaaccttgctctaatcctaggagggaatttaaccagctaggaacgtgatacagatcaccacaagaaaactgggtggatgatcactgtcaccggtgaaaatttgttttgtgtgcatatataaatgttccctatttacaatggcttgacttcctggtggttaaaaagtgatatacattcagtagaaaccaaactttgaatttcaaatgttgatcttttcctgggatagggatatgaggtctgatactctctagatgctgggcagcagcagggagcagtagcaatcatgagggtaaacaaacactactgtattccatactgtactatattcaatacagtacaagagatattcaacactttgttataaaataggtttgcattctatgaatttgctgtaggctaatgtaactgttctgatcatgtttaaggtaggctaggctaagctatggattccataggttatttgtattaaatgcatttttgacttataatattttcaacttaatgatgggtttataagaaggtaagttgaagtgcatctgtatatatcaatcaataaagaatgggcttccacttcattttaaaaaattgctttaaaaataaattgaaatttacttaggagaggtttgttttgtgttaaatattagttttgttttacacttaaattatctggatttattaatttcccaatgtcttcactaaggcaaaatttaattggaattgaaatcagatacattagacacattggagtttatataaaatcaagaaaattttctaagtataacattaatagtgatcattctaatcataattattcaaaagacctggttcaatacagcattggatttattctatagaaaatgagatagaaatattaagtgcactgaaaataaactcaacttctctataatattttcttttcactaaatattaatatttatatttcaaggataaacattggtagggaatctgctgaaatcaggtaacagtattctatgaatctagtgattagaaaggaattcaactaactggtaaaggggatacatttacatattttccaggctatcaccaccctttttaaacagtcctgactcgtctttggcaattgtgctctatgggaaaataatataacactttgttttataattttaactttggaaaaacacagcctcaaataaatgactaagtttgcttttattcccattaaacgttaaacttaaaagttcagatttgaggctgggtgcggtggctcacgcctgtaatcccagcactttgggaggctgaggcaggtggatagcttaagctcaggagtttgagacctgcctggctaacatggtgaaacactgtcactacaaaaaaattaggttggtagggaggcacatgcctgtggtctcagctactcaggaggttgaggtaggaggataacttgagcccaggaggtccaggctgcagtgagctgagatcacaccactgcactccagcctgggtgacagagcaagaccctgtctcaaaagaacaacagcaagaaaaaacaaaaattcaaacttaaaagtgtgaatgcatccactgttggggaaatataattagaaactaaatctttccccaacccagaacacttctcaacaaacatagtagagaaataagccagttttattattttaaaaagcatgaaaccaggatgtcatgctaatcacattgaaaagacagaaaggaatttcaccccctataggtctaagcagatagacttattacatacatgcgctcaagacagacaatcattagtcctcaagtaagaggactttgcaataccttttgtcacattcttttatcttaattttatcatgataattggggagactccctgtggctgtatcaggaggagtaacaaacttctcattgcaaattggaacaagatgcccacagatgttaagctcttttcctcccacactaactgaaagatagggccactatctctctttatgtttgcctttcaaaaagatgcctacccgatgaagtcttcctaaaaggcacaagagaacaggattcaaaagtttctggatggctgaacatgtggagggtcctggagggttgaccacccagggaggatgtggaagctccacaccccttcccccataccttgccctatgtacctgtatcctttgtaatatcctttataataaactggtaagcaattttttaaaaaaggcttacaggtacttgaggaaacattcctgaattgtgagactggcagaggtttatttcgccattatcaagatttatatacatttgaaaaggacagagaaaggaattttgaaataaaaggaaaaaggggagaagtctcttgcctggtaaaatgataattcttatttttaatctatattttcccctacatcacccacaggaatatagaagtagtattattttattatgacttttttctctccccaacctttcaaaaataatttggagagctttctttgggtgctacctatttcgtttaatggctttattgaagtataattgacacccaatacactgcccatatttaaagtgtagaatttgatattttgacatatgcatacacttgtgaattgagagaaaagagggatgagactagtccccccacccttactaatgcattttttcccccacatttgatgatacaggctgaatgtgtgctcccgcccaaatctcatattgaattgtgatccccagtgttggaggtggggcctggtgggaggtgattggatcatgggggcagaattctcatgaatggtttgtttaacttgctctataatgttgtataataatataacgtctataatgcaggtcagtctattttaccacagatagtgaggattgtacagagatcattgacaaggtagacaacaagtgagtcaaggttagagagggtaaaatctagccttctcaattccaagtcatatttttcttctcccttttatgtttcacagttcatttctactgtttcaaagaaaaccgttctttctaattaaatatttattccttaatagacatcctctcctcttggtactgtccttgagatagtgagtgagttctggtgagatccggtcatgtaaaagtgtgtagcacctcccctctcactctcttgctcctgctttttccatgtgaaggacgtgatactgcttcatcttccaccacaaataaaagctccctgaggcctccccagaagatgaatcatgttggcaccatgctaatacagcctgcagatccaattaaacttcttttccttagaaattccgcagtatcaggtctttctttatatcaatgtgagaatggactaatccacatgccacctaccagaccttgcagtaccatgctcacgggcgccatacctgctgaccagaccttgcaaactgtgtgaagaaactaagttgagcagcattccaccaaaaatcttactcaaaggagtttaccctctcatctacagtatgtacacaaatcaggagaatgacccaccttgaccccttgactcattataatactaaaatccctgccaaaggagggcgtatccaccattttttgatcatgtgttgcgtgaagaagtacgtttctaaactgtgcttatgccactgaaactcctccctaatcatgccttgatacctttcctctttccctccagaattaaaaaatcttgggtggctcctcatgggaaggcagagaactatcatccctgtgctgtttcccttgtgctcaagcataagcccctaataaaatcttgtctgaaacaattttcttggccttgtgtcaatttctattgcttaggtgcctaagaacctgtggtcgttaacaaagtcatcaccactttatcttccctacaccagccatacatctttagtgtgatgtacggctggtgtgtctggtcaaatttcttgcccaattttagttttatttgggttgtttgcttttttatggttgagttgtgagtgttctctatatactctgcatgcgaatcatttataagatatgtattataagatacatgttttacaaatgctttattgtagtctataacttttcatgttcttaactgtggctattaaacagcaaaagtatatagttttgataaagttaatttatcgatttgttcttttatggagtgtacttttgactaggagaaatttggctaaccctaagtcactaaggttttctccaatgtttttccctctaagttctgtaataagttttatatttaggcctatgctcaattttgaattaatttttttgtatatggtgcaagatatggattgtagtgctttttgttttaatatggctgtccaactattccagcaccattttctaaaaaggctatattttgtccactgaaataaatgcctctgcatctttatcgaattcagtggtctatatatgtacagctctatttctggattctgttatgtaccattgataactttatctatacttacatccattgtacactgttttagttattgtaagtttgtgtgatttgaaatccagtagtttttaccctccaacattattcccctttttcagagttgctttacctaatctaaatccttcagattttcatacaaattttagaaacagcttgttaatttctacaaaatttcctaccaaggtttttattgggattaccttaaatctatatagcaatgttgggacaattgacaccttaaaatattgagcctctaacccatgaatgaggtatatctctttatttatttaggacttttagaatttctttaatttgtataaatattacaaacctgtaaacaaatcattataataaaaccatgagcctactaagtaaatgctactaaattatgcctccagtatcagaattttttggagagcctaaaacctttcttctgattcacagtaagtaggtgatcatcaggtgaacaagcgagattggagagaaaagaagtacaaaagcagagagtgtagttaggattaaacatttaaagacttgcaagtagttatggtttgacatatctgaaaccattggttcatatggggaatgtaaaggaagaagtgtggctagacccttgtcttatgtgctcctgaagacaattggtcttcatcctgcgagcaatggggctattgaaagattttaaacaaaagagtaacatgactgtttaaaagatcactctgaaagttgaatgatttgttttaatatttttaaagttatttgtgccttaacctttctaaactatgggaaaagtctccaagttgtggaatattataaatactatataaatataacttacttttgattgacttaaaagcatctctttttagcattacaaaatacatcttagcttgctttatattggattttggtgagcaagttaaacactaacactatgcctgattctaatgttatctgtattttctattgtatcagttcttttcagcatactgtctcttatcttcatttaactgtacagtttcattctttttcttattattgttcattgttgtttttattatgttaaattatagatccccttatatatttagtaacttacattaattactccctttatgcattcctcattactaatgtgtcccctacttaacactgccaccaaagttgtctttttcactctatcatgctccttattaaacagttatggtggttttctattacatcttgtaattaactctctttatataattaattcatttgcttttcctttccactctacggggcaacatacactctgccatttaacttactttctaccttttccacaaccgaagtgagtgtcagcgagtgagggatgagcgttttttctttttttttttttttaatgagacacagtcttgctctatcacccaggctggagtgcaggggcatgatcttggctcactgcagcctctgcctcccgggttcaagtgattctcctgctttagctctggagtagctgggattacaggtgcctgccaccacgcccggctaatttgttttgtatttttagtagggacagggtttcaccatgttggcaaggctggtctcaaactcctgacctcaggcgatctgcccaccttggcctcccaacatgctgggattacaggaatgagccatcacgccgggcctgtgggcttcttaatggtttcctgaattcctgtgtgtctctttaaaaaagaactgctaccccatccacaaacattttgtgaaacatctataatgcgggtcagtctatttaaccacagatagagaggactgtacagagatcactgacaaggtagacaacaactgagtcaaggttagagatggtaaaatccagccttggtcaattccaagtcatatttttcttctcccgtttatgtttcaaagttcatttctactgtttcaaagaaaaccattctttctaattaaatatatattccttaataaacatcctctccctttctatttcatttattgattatctttccttctctaactctggacttttatttatttatttatttgctgagcgggttcctcattgaatttaaaacaactcttttccccaccatatcagcattgcttgtatcccttgaaggtgaaaggatatttctgatctgacctaattcttctctttattctggtactttaaatttattattgttattattattattattttgagacagagtcttgctctgtcgcccaggctgaagtgcaatggcaggatctcagctcactgcaacctctgcctcctgggttcaaatgattctcctgcctcagcctcccgaatagctgggattaagctgggattacaggcacatgccaccacgcttggctaatttttgtatttttagtagagacggggtttcaccattttggccaggctcgtcttgaactcctgacctcaggtgatccacccatgttggcctccctaagtgctgggattacaggcgtgagccactgtgcccgacctactaaggtactttcaaatacaatgctttgtaaagtctccatgagatattagaactccttttcctggactaagtagtgggggtaaattgaccaaatccatcttccttgcaagcatattgcctgccctccttaaccttctcaacattcttgattctagccttttaaatggttgtatcttcatacccaggatagcataagctgtcccctatctttttttctcaaatacagaaatctggatttacttttggaactcactgaagtatcactgaaccaaatcctgattattggaatgttttattacattttattaagttgcatatttatttatatttaagatgtagtttacaaaaatcactctctacttggcaaaattccagtttttgatgcaaattttctgatatggcttgcagaattatttgtattcaaagaacgattctgcttgtattatgaacaattgtcgtgagattgaagaatatggagatgtgtattaaggtaatgagtaatgaaatgcctctttttcccccacagtattttggataaaagtcaagctaggttgattagctcagtgtgggttcatagtcagagccataggatacttgttgaaactttcatcaaagtgagactaaaatacaaaatcaaatatatttctatctgagacaaattcaacaactataagtaataaatcatcttttttctcttgattacatgcttccaaatattactttaaacttttccccattatatttaagcagtcatattattgttgtggtgactccgtctaaaaataggagtaatattttgtttcagatgcttttgaagtatacaaaataatttagaatcaattgcttaaaacataaacaaattatgacaattttctactgtgaatccaaaagtcattttaaatgaaccaggattttataaattataacaataccttcatacatttaatgtagtaatatacatatataaatatgtgggaaacatactatttatttatctacagacccatatttggagcaaaggttgcttcctggacacgttagattccaagcaactgataagtgcgtggagagcaaatgaaacaacagggtgtgatcagggaaagaagagagatgttcacaacatgaagtaggtcaaagggaggtagagatggtcaaattcctccttaataagagatgccagcttatgttcagaaatccacacacctggcattcctaacattaagaatgcaatggacattccaggtcaaaggaaatgctctggcagttaatgtgcagctattgcattctaacttgtgtttgtggattccctgtcactggatggaaccagacattgcagtacttttgcagatatgttataaatgtgatcagagtttatgttttctcttccggtggagtttttactagacttagcccacggctaactgaactgaccacagacaacactttgctgcgtagcattgaagggcatatagctcaattagtagatttgtggcacctccatgtaaaatccaaagaactctagaaacccagccaagtcaaccaacatgagtgtgagccaatgctacatgaaaataattcctcaggccattgaatgctacttggcattgaatagcaacaatttgatttatattgcctttatgttttacaagatcaaactccttttttaaagaatttttttcaaatatactttgaagaacaataaacaatatttttaaattcactgaggaaatgttggaataggtattgtgccaaactattcaaggcaaagtgtataagcttttttctgccttagattgtttcatgctttgatctcaataagccattattttttctcttttaggcatttagctgaaaaaagatttaactaccccacaataaataatgtccccatctccctgaagttttcagatactattacttttcagtttatttctcttaagaaagatatattaattctgatttacacatgatactgtgcattgaaaacaagatgatgagggatagtttaaagaggtggagattgggataatcttcccaaattctgttttccctccacccctagtctattctaatgatacagtttggatgttttgtcctctccaaatctcatgttgaaatatgatccccaatgtcagaggtggggcccagtgggaggtgcttgactcataggggtgatttctcatgaatggcttggtgctgtattcatggtaataaatgggttttcattctgtgaattcacaggagatctggttgtttaaaagaggctggcatctcctccctctctccctgtatctctcattccctctccagccatgtgatgcacctatgccccttttgccttctgctatgattgtaagcttcctgaggtctcactggaagcctgataggtgcaggtgccatacagaacagtaagaccaataaatctgttttctttatacattacccagcctcaggtatgtccttattgcaatgcaaaaacaaactaacacatctaacatacgtttgaagaactactgattgacttggctgtgtccccactgaatcgtatcttgaattgtagctccaataatccccatgtgtcttggcagggacccggtgggaggtaattgaatcatgggggcaggtttttccatgcttgttttgtgatagtgaataagtcctacaagatctgatggttttatagagggcagttcccacacacacactctcttgcctgccaccatgtaagatatgcctttgcttctcctttgccttctgccatgattgtgaggcctcaccagccatgtggaactgtgagtccattaaatttctttttctttataaattacccagtctctggtatttcctcatagaagtatgaaaatggactaatacgactcaaatattagatacacatttttatcaataatatagcataaggaacacactcccaaaatatttaatttaaaatctagaaaaaaagttttgtttaatcaaggtgaacaggtataatgctgtgcagtagtatttaaggaaaaggaaatagctaagattatatttaaaagctttttaaaaataagaaatgctatataaattttgagaaccattagggctttctcttttaaatattaacttaatctcatttagtcaaagtgacatatgggagtaatttaaaactgaagaataataaagtgtaatcccttgccctaatattctctgcacccaagtccttcctcagaggaatatactgtcaaaccttttagctatttttaagacatttccttttgtattcatacatgttatgctgctactattattacttgatttatcgtgtgtgtgtgtgtgtatgtgtgtgtgtgtatgtagagagagagagactccctcttgtgatattaacattttagacctgttatatagaccttcatgttagttttccattctcatacaacattttgtatgttctggagttaataatttctcacttcatctggtgtttagttgtcaacatgccaatctctaatattttcttaaatgtgccttctgatgtgtcaaatacatatcaataaatgtactgaaagttcaaacacattgaattatctgttagttacatttccttccccaacccccaacaagagttcctccttccaaagccttctgttgcccagttcaaaacagaattgtttccaggagagaaaaataattcttaaaccaggcataccgtaactatctgcaaaggaaaatgttaaaaaattggactggaataaaaccacaaattgtttatcaaaagatatcatcatgggcttggacagataagagacatattgggagaaaatatttgcagcttatttatttgacaaagaatagaaataaagaatattgaaagtacttctaaaaataaataagcaaaagctaacacctctaacaagaaaacagacaaagacttgcacaggaagatcacaaaagagggcatctaaatggtcaaaatgcttatggaaagatgttcaatctattaatcatcagggaaatgcagatgaaaaccacagtgagcaataccactgcaaatgtgccagaatggagttgccaaatttagcaaataaaaacacaggactcctacatatatttgaattttagacataaaatgaataatttttagcataagtatatcccaaatatttctcatgtaagtagacatcctgtattttacatctggtaacgctagccagaaagtatgagattgaaataatgagcaacaccaagtatcagcggcaatgtggaacaactggaactttcaaagattactcggtggagtgacaattggtacaacgtcattttgcagaactatctggtagtgttgcttaaagtggaacacagtaaatcttagaactcagcaattcctctctaaaggtgtactaaaagtcatgtacaaggatgcatactgcagcactctatgcattacaactgtttaaaaagatgttcatgttaaaaagttcattgataatgtaatcaatcaataaattgtggtgtaatcatatgatagaagatcaaatagcaataaagaagagaaaactgcatctatactcaatagattcatatcaccctgaaacataatgttgactgaaaaaaggcagacacaaaatagtacatttcatatggtttcatttgtataaagtttaaagacaatcaatccacagtgttagaaatcaagaaactggttaccaagaggaaaatagtaattgagaggaggcatagtgagagttttgataatgtttcatttcttgacttggatattggttgcgtgggtgtgtttgttttggaaaatcatcatgctgtacaccttttttgtttgtacacatttttgtgtatattatacatcaataaacagtttgtttaaacaattattaacaaacggtactttgtttttagttatagaatatgatttgtgattcacatgacaactgattttaactggtgagccatggtgacacatttgaggtcaacggctgtaaagagctcccatgcctgtgctcaggaacagagggtcttggcattcttcctgtcgcaactgggggtgagaaaacaaaaatgacctttctgggaaaatacactgagatgcatgtgttagctttgttgagaataactgttcaacaggctcagggcattttactcaagtcttttctgtcttactcactgttaaacattgcctctctggtaggctatctctaatatgtattgtttgtccatcttcctagcagttggctgggatttggctttgctttaaaagttaaatgtttcctctttgtatgccattagcttcatgtgtcatgttttctaacccttaggattatctggaccagtaatcccttgcccgtcccttgcctggttcctgtgcctttggattccgttttgtctaggatgcagataaacttaaagcattatattataaagaagtgacattagtgtctagctatatggctgaggggttcctttatctcagaacaggaaagtgagaagttaccactgagattcagctatacttatcattatcacaaacaataataataattatgtaactcaaagtgtcattgttcctgatacaggggtttggccccttgtctggttgaagacaaattcctggtctcctgtgggttcttcctaaaatcccctagactttactattatttttaaacttagaaatagacccctaatgttttatgctctccatgaccctttcctgatcatctgtaaacttgagtacaactcctttggaacacatgttctttcatgtggtggaaagaatgctttggagtccgacagacttagctttgtacccaggctgctccacttactggctgtgtgaacttaagcatgttactctctgagcctccattaactctgaggctaaagatgatattgttatctggagcctagaattatggttagattatatgaagtgtaaggcacttaccacttttctgggtacaagaaactttcaaaagatactagtttcttcctttcttcctttctcttccatccctgccattactttcacagcttaccgcgtccttcctaaattagttgatcaaagatccagaagtgcatcaattgtgcgttcacaacatcaccaccatgtacatatctgcttgaacgtttatttcctagaggaatatctgaatgataatcttagaatatcttcattgaatcccatgcaggaaacataagcaaactgcagctgactaatatgataagaaatattacagacagttagatcatgtggctaatgaggacacactgtgggtggtgcagggaggaggaggagaggtcaagtgagtgcaaacccatccctaaggagggtagtgtgaagtataatcagtaactccctttttagcttttcttaggaacttcataactatactttcattttccccaaatactcctcttactccctatgacagaaacaaacagaaaagttttaggtaagtaatcagttttatttgttgactgagtgaaataaatgaatgcaataatgagcagtaccatgtataaagagtatgaattttggtacaagacagcacaggccaaaatccatgatccacaacttactagccatgtgatgttggaaatttaattcagttatactctgtaaggctcagtttcctatctgtcaaatggagatcatatctgtctctcatgattatgctaagaagatgatgtttatatggtctttagtgcattgcttaataatgtttattattaatattactatcactctatgactcctgttaccgctaccttacttaaatgtctcatccagacgtttcatgtcttatggtccaacacactcctattcttgtatataaagggctcagaggccccaggctttaattccagaaaggacactaggccgctttttcagagatacatgctccctccctctgctgcttccaagagtcgtgatttgctgcccctttccactaagagagttgttggaattgcagcctctctccttctcaagcttcagtggttctgggatcacctaagtcttctcctctggaaaactggaaaaacattctcctctttcctattcaacattcatactcctgacagtggatttttactgcactgaaataatttatatgcccttcaatctatagatggaaataataaacactggcaggtctgttcagttatccaacatcaaattcccctgggctgtgaaaatcagatgtctacgtgctttatttttgtgtaaatagattgtagtttgttcctgaaacttgtttttaatggctgagcctcatcttccatcacatttatatagggtataagtttaatagcaactgcggtattatacacaagtatttttaaaaaccagaagacattttctcaaaatatatgcctcccttgatgaaatcttctgttgcattttccaaaaaaataaaaaaaaaaagggggcctttggaataaaatctgtctaattatttgtagtataagccttttttctctttttattttttcccttatttggaatgcttttgttgttgtgtacaatgcttatgcaaccagtttattgcatcagcaggatttcaataggcacaaacgtaaagtaactttgttccttctccctaaatgctccttttgacttaatgtgccaaattgttcttttctatccatggatgaggattccacagctttgtcagctactttctggaattaatgagtagcatcagtttccagcatagaaagagcagcctaatagaaaatgatccatatgtgatcagatttctttctttttcttaatttaagacagatcttgctctgttgccccggctaaagtgcagtggcacgatcacagctcattgcaacctccacccgccaggctcaagtgatcctcttgcctcagccacccaagctgctggaatcacaggcacccaccaccatgcccggctaatatctgatcagatttaaatctctctttccctacctcagtcctgcttctggaaaatctgcagtaagaagtaggttttgtttatgcactctttcttcatctgtttcttccacttcccctgtgtttactatgcaacctctgattaatggttgggtgtgagagtggagattgattaatggggaagtgatacggggcacaaaacttcttacctgactggcgcagttattatctcctactggagccctctgacatggcagattccaaatgctgatatttctcttataatgcaatccttgcctctagacttctcgaccatgcatcgggtagcagaccctgcatttctctaatccagagctcaccaggccatcctccattcattgctttcacttagcttggggatttggtgacaaagactcattccttttttccccagctttattgaggtctgattgacaacgtggtataaatttgtggtgtacaatgtgaggattagatagatagattgatgattaggtagatagatagacagacagatagatgatagtgacatgattaccacaatcaagatacttaacacttctatcacctcagttactgtttgttttttaatgctgagacaaagactctctcttttatacagattatagccaggcttctctgagccctcttcttaactagacttcagccttggcctattaagacttaaacaacactcatgtagtttctagaaactcaaagtcgcatctgcaaaataacctttgccccccttaaagtgcctgtctgagaaaactcaaggctgccgaagaaatgtattattcgttccaggcaacacctgagaaaagggcctctgtctctgagtctcttggggagaacagggtcctatctttgataattgtcagttagtggacacagctggtctaatgacatttacactaactaaccctctgtaatttttcacttccatgactctgctaagcctctagttccctctccttactccctcaccctccctttaaaacacttgctcatctctgtacaaattggagttcagttcactttggaccgttttttctattgacatagttattactgatgaaaatctgtccttaccattttaactagggtctagctttgcttatctttgaccttgggcccgggggtaggaaaggaagtctccaagatggtctctatctcttgacctcgtgattcgcccgtctcggcctcccaaagtgctgggattacaggcttgagccgccgcccccggccgagataattttttaaaagtttcatggggccgggcacggaggctcatgcctgtaatcccagcactttcggaggctgaggcgggtggatcacgaggtcaagagatagagaccatcctggccaacatggtgaaagcccatctctactagaaatacaaaaactagccgggcgtggtgtggcaggctcctgtaatcccaggtactcaggaagctgaggcaggagaattgcttgaacctgggaggcagaggttgcagtgaacccagatggcgccactgcactccagcctggtgacagagcaagactccgtctcaaaaaaaaaaaaaaaaaacaaaaaaaaaaacctcattagcaagttccacatagatgctggaacttctttttagattatatgggttcttaacaatcctttattctatgcaatggaccctcaactgagagtaagacaacaaaatatgttgtatatttatcacaaagctgtacaccatgaatagcataagagcttataaccagtttctgatgggtagcacattaaccataatttgttttaaatcttgatattataaaaggaatattaagcaaactgtggaggtctgaaagtattgttttttgatatacctcatagtatagctcatattcaactgatatcacatgatactatcacataatgtgatagtaatggtatatcagttgaatatgagctatactattttctctttaaagtttgaggatcttccttttctattaattttgccatgcttatgtgggtatcctattttttttatgatgggatgaaaattattaagccaaggcttctgtgctagctgttattatcaatgatatcaaaacactcatttttgaacagtataaacatatttcaaaagcaatctgtaataactcttaaaatagatatgatcattaaaatggtaaatgtctactgtagcaaactgaaaaatataaacatatatgaacagattgaaaacaccaataattggtgaaaaatcatgggtaacttattttaaattttgatgtatattttctagtttctacatccacagtgcatatttttttctactaatgagataatattgtgtatttgcagtttatcctactttaaaatttagtatatatcagaattaatcaatagtctttgagaacatggcaaatatgttttaatggctgaataaaagtctatcatatagttacaacatcacatattttattttgtctctactattgcgtatttacatattgcccattttattataataagtatatcaataaatttctttatatataaatcaatgtataaagctccttttattagaatgtaaatctgcactgactgaatcaaagatcaaagtttgaacattttgctcttcttgaaagaaatttacagtttattccctagattctattagtaatgtatgagtgccactattatcagacgctactagattgaatattgctttctaaatctcaatgcttttacatgtaaagatggtattttattatttgcacttttgtttctctgataatcatgccttttaagtggctttccattttcatgaatgtctaagccaattgaaatattcaatctgaatatgccttactcaaaatcagatatttaatgagaatcttttctagtactgaaaaaataatgtctttttcaccatgatggtggactggtaactctgtgtctgaaaatctgggccaaaaccatgtcaatatgagttatgttctagaactttgtggccttgacttttcatttattttgtgtgtagcaggaaaccaaactactttctaaatgcaattctgaccctattgtcagcccagcctacatcagttctatgtaaagtcaacacttgcttttcttgtgagtgtcatcctaatggcccttttcaccctagtgacacaacactcctgcctccttatagcagcagctgaatccagtttgcagcttccccaacacttgctagactagctccatcacatctcatccgacagattttggcaccaggcagcaggcagcctgtcagcaaaagttgaggtgtcataataaaaaaaaaaaaaaagttggggagtcaggcccaaggagcccttctccaagctcccatgcaccaccatcagttgagctgcaagcacttctaactcagaagtccgaacttaaccttcatgaggttgctccaagtttctaggttttaataacatcagcctcttctttgtttccccagccctaattagctatttcctgtaattgctactcatcatggtccctttcaattccccttttatccttttgtgaccttgttaataaatatatatgtagtttaaaattctgtatattattttctctttaaataacttatgagatttctctctcttgactgaaccctgagtgatacacctagataaaggcaataaccaaaattatggacatattttctttattgaaaagtataatgcctattatgggaagggccagacttttattttttattttttatttatttttatttttttattgatcattcttgggtgtttctcgcagagggggatttggcagggtcataggacaatagtggagggaaggtcagcagataaacaagtgaacaaaggtctctggttttcctaggcagaggacgctggggccttccgcagtgtttgtgtccctgggtacttgagattagggagtggtgatgactcttaacgagcatgctgctttcaagcatctgtttaacaaagcacatcttgcaccgcccttaatccatttaaccctgagtggacacagctcatgtttcagagagcaccaggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcgacaaaacagccatcgtcatcatggcccgttctcaatgagctcttgggtacaactcccagacggggtggcggccgggcagaggggctcctcacttcccagaaggggcggccgggcagaggcgcccccaccttctggacggggcggctggccgggcgagggccgcccccaacctccctccctgacggggcggctggccggccgggggctggcccccacctccctcccggacggggcgcagacttttattaatgtgcaggaactttgagttatattcagattgcatagtttgagatatgtaaagtattatagaacaacaccttttaaagttgagtagatgaaaatggcaaaactaaaaattagggtgtttcataggatagaatatttttcatccactttgagagaaattattaaaattagaaggtttgtggatgaataaatggatgaaaatataatttctggggagaaacctaaggcaaaagaaccattctcagtgctcactggttcagataaattctatgctttggaattccagaaacctaagtgattcttatagctggcagtcatcaatttaagacacaatgacatttcattcgcttataaaactggcaccattggctttctggtacagctttccagaagcagtgttgaattttcccagatgcagtcttactctttcataggacccaataggcactaagaatttgttgaagaacaaacagaagagagttatttcgatcaggaccaggctgaatgtgtagtttcagctactttagcattgtgacctatctgattcaactattttaacattaactcacagaattttagtacattgaaggaccagatcaaatttcttgtattgattgatatttgccatcccaggaaggcatgtttagtcccagaagactgacagacaggttaaaataatcttttaggttgacagttgacataagccactgcccatttaaaaaataatagaaaatagaacatggggaaagaagtgttcctaagggtactgttgcccagaaacgatgtagtaaccaatcaacaacagaagaatagaactcaaaaacgtatacaaacctgttgagggggaaatgtgaaaagcaattctttaagtaagaacaggcagcttttctaaaatgtttgataagagaaaataatatataaatggtatagaaacagactaaaaatgaacaaacacttattcagacacatttatatttgtgatacattctcatttctgaaaacaagatgatttgtgctgtggatggtcctttggtgaattttgttttcttttgctgctgttgttggcttggaggtaggggtagagcaggacatacagaatgtgaatttgtagctgtgagtagccattttgtttttgatttttgtgtttacatgcattttgagagtgaatatatggtgtaaacactaagatgactattcgttcttatacttgaaataaattaggtaattttccacttttttatttctaagaacataactatagttagaactattacttcacaaatccagagatggagaaacatggagatgaaatgatgtaaaaatagtaaaaatattcatataggagtacatgtggttcacaaaagcttacattttgagtggagttttataaaactaatattttacctattaaaactttttcagtgctctctaacctatgatatttgcgagtcaaaaatcagcatgcatgatacaaatattatttctgtaacaattgtatgacagttatttggcagagtgaattactgattatcttactttaaactgctaccggattcaaaaccatagctattacctgctccttagtacagcacaaacagaaggggcaatattgctatttaagattagattgagtctagaaccttttatgactggatggttattcattgtgcaaaagccagatcgatgaaaggtgcaaattttagagtcaaaagtgaaggagtaagaaagactcaagctttccttctacattgcatgttctagttgctaaactgtcggcagagctggttttcagttggaaattatcaagaaactctacccaagttttggaaatccttaggatcatggtatcctcaagttagagagtagagttacatggatcaagaaatgtataaatacaagaatataaattttacacttgattactacttgtttacctgaagcaagtaagcaaatgcattatacatactaactgaaaacttatgtgattttaaaaggtcttcttgagtgaaattattaaccatttgatcatatctaatgcataaatacacagagtgagttatccttcttcctatttcttttttttgcttatcaatagtaaaacaatatagaatgcttaaaaattaggaaaaaatcgtaagcaatcaatcctaaaaaagtaacctattattttgtttagtccctttaggttgtttatatatatataatgtaactgtaatattaatgaaaatagcatttttcattgcaatattttataaattattattggataaacatgtatatatcatactaaagacaatatagcatatgctataactatatactatatgttacataaattacataaaaatagtgtatgtactatgtattctataataattacatactctaatttaactatctcttgttagaaaacaaagcttctgatctttttttctattagaaaaattgttttgcttatagaccttttgggcttacactttttgatttttacctaagacggcaatgataaaaggactgtatgggaatgaagctgtagcttggaactcattagtgcagtaatctgattaaccaatgtaaattagccggagttgctaatgtattcttcagctgagctgatgctttctttaatatgtccttccaagaattgtgggaaaaagagcaggaggcacttcagggcgattctacttcctgactccaatttctgactcccaatagtttctcttttgcccgaaacattttacctgtggggagaatcccaggtaaatatggaaatatcactgtggaaaatggaaacatggcaacggtagactctgaaattgatgaatattttggggcaggatactagtgggctcagttatgagctcagtgtgaatgggaaaggaaaatgtaaataaacaaaattaagaaattctagccgaggtagagagtccaagttaaaaaaaaaaaaaaaagacattctatgagttttttcttccccctcagagactctcagattttatgaccaaaatggtgttaaaggaagaaaaagaagaagaacattattggttgcattgtagcatatccagctgccattgaagtattgagcatgtggaaggaaatgtattttgtctaaatctaagaaaaattaattttgattcaatagggactatttaaaataaatatttggctacttcatagtgacctgggactaacaaaatctgtttttgctagttcatcatagctcaacttgaatcaaactaccaaaatgttattttaatggattttattggtcagtttttaactcttaagtataaacatataaattcacttaacctcaatctagtcttatttatagtatacatatggctaacatagagttttaaaaaagcatcttctagtcactgaatacatttttaagataatttaaacttgttgactagatttttccaagaagggtttccatggatttttgaaaataaatatgccttcaaaaataggacattattaagatattcttcctgatcctctcttgacaatttccaaaacaaaaattgaaacttagtttgacctcttgtaccatactgtttgccatgtattcaaaaactaaattgtattaacatcacaaagaaaacattcagtgaaagagctgccatggaaaactgattttgaatgggacattccagagtttagcattatcttcagcatcgaaatcatacaaaacttgagctctcatagggtgtttggtactcaaattggcagtttttatatattttttgttttgtttacaattttatgttgattaaaatagtattacttaattcaatacaaaataataccaatttgttacttcggtggggttatgactagaatatttttctagtgagagaatctagacaacaatccttttttattcaatttatactgcagaaaaggtactctaaactgacacgatggagtcctgcaaattttaatttgattcataaagaagaagccctttactgataataatatttacttttttgagttggctttaattcccccacccacccccaccctgcaattgcaggaagcagacttcattacatcacacgaaacctccttgtccatgccctggcactcaggatgcctctaagggtgggatagctgtcctccctgcagctcttcctaatgggaagtcataaaaccaggttggagcaattcactgaggcaggatgatagtttttttgcatttgttttcttcactctttagtgatgggataaaattataagcaagaatgtgtgttttttttaaagggttgtagaaagacactgataaaaattcttctaaatttcttgtatcttcccagatataatcaggtgactttctcatgttttagatgttatcataggcaatcatttaacctgtagttatggaattagataacggtagctgttacaagtagctaacacttatgtgacacttcctgtattatgtaaaacagtattgacttatacatcatgcacatctagatagggagcattattgctccgtttgatagatgtggcaacttatattccagctcaaagaaatttaagtaactttctcaagctcacacacaggataagtagcacggttgagatgcaaacccaggtagtcaggctctgacagaacatgccatgatgatcattgaactttggtagtttgtctttctttcataagcagagatttaaaaaataacctggatttttctatcttatgttttctatcatttaaaattaagactttacttataagggctgggttaatctcttaaacagaaatcataatatttctgaggatgactaaaagctgtacacttttcaagagattattatgcatgagatgacttagaatctacggctgagaagagatagggaagtggtaaatgtggtatctgatctggcccaaccctactctaaatgggacatttcccttcacccccaccccttcttagtagaatgataaatatttatcagtacttgctaagtgccgggcattgtgctaagcattttgataataacatatctaagcattttgataataatgtatctaagcattttgataataatgtatcatgtaattaatatccttcccatttgatagatgagacaacagaggcttagagggttatgcagtttgccaactctgccatagtcaataagtggcaaaggaagtatgaaccctgatgaaattataccaaaaatttgcccccctgggcctttgattagataaattaataaattacctgtactaattaggccttatttttttttttattactggcaaccaaaagcatcgtaactgacataagaatgtacagccaatgccattttggtgtacttcttaggaataatatagtcttatcttgggtagagaaccttgggatttgttttcaaaaatttacatctgcttcttcattaatatttaaaatggtggatgcagcagcagtacatactgttacgattatgcttgcttcaaaaggaagttgtgatacagagaaattaagtactcttgtgattcatgccataattatgtaaagttaagaaattagagaaaagagtgtgcaggaaggtagaaggaaagagttgaataagatgtagtcatttaaatgagaaaaaacataaatggcatggagaaaactcaatctgtttttgtttcctctttaccaaattaaagaaaaacatataagtaaggtctcatactcagagataaaatggttagatatttatttagtctcgttttagtacctcaaactccacagtagttaggcccctttcaggctcaatatattgaagtgagaagaagaaacacacacagacttagttgatagctggacacaggaagattttcagcaaggtgatgagattaataattgatattaatattaatatcttctctattaatatctttattattaattatatcttattaatatcttctctattatttcagtgattcgggtttgtcacatttacacactattaatggataatgaatagtacttttttgattttagtaatctgttattctagtttttcaaaggaatcttgccacacagcaagatttatcccccagcatggggctaagccagggacttgcctcaaaatgatcaggataatcctggatgaaggggctgtggccaccacaacattaacttccagtttttatttttagcacatgactagagtcacagagctatgctttcagcctggctgagtcatgattcatgaggtgactgccattctattgctcaaactttcaatcctgcaaatggagaaaatcggaatactcacaagtcccaggaattttacgaatgggttctcaattcaggctgaacatttagtggatcaacaagccacgaaataccctccagagaggatatgtggcattttcagtctcttttcttgcaaaatgttgagcctcagtttatggccaatatctaaactgcctcttcactgcctatatctgccactttaaattatttcctcatttatgttaggtggctttgtgtagattattcataaaaaaaaattgtactaagacattttctctcacctcagtgcttctaaaataaaaggcactaaaatttcttaaagacagtaagagctttcatggttggccacatgtaatatggaatcatcgtattgattaataatagctttcagattgactactaaatcatccattatattcaatgacatttgctacttgtatattttaggcccttaaagagatggacatatttttgtaaaatcttgtgctaaagtgcttgtattattctccaactataattcttatttctgactttgaccaaaaaggtttcattgtatcatagttcaagattgtggaagtattcttgcttctagttctcctttatttgtctttcttgaatggttcattttgttacgaaagatactcttacgactctgataatacttttctcaagatgccatcacttgaaaagacagtcatatgcatattatccaactagattacatagtcacaagtcagacgcctgtgtctttctgagctttattaagaatgtcatgtgcaatatggaaaggttgcactttcttgtagacctttgttaaagacttatatttgcctaaattgactcattggcagcaaatcagagacaaagataactatgcatactccgtcctattagcaaaaagttttagggttgcatatatcattttcgtctggacaggtagcaggtcattttgtttttagtgtatgtgccctggaataagagatggtacttgagattaacaagactattggtaaatctggtaaaaacccatgcactctttaggacttatgtttggtagattaaaagggtaccattttccttcttatgttttcaggattttcctcatttgtagtgtcctgccacttatacacacaaggttcctctgtggtaatgatggaatcgagattccttctagaagaaatttgcccttttctgcccatccccacttcccagttgcataagagaaggagattgaaaaatgtgaatactatacataaaaactgaaatcagggtatcaatttctcattcgtctacttaaaaaacaatgttaaaaagacaattttatttaaacattaaaaataattttatcccaactaaaatttttattttctacattcattttcaattgttcatatgcataaatatgacatatgtaattaccaccaaagaatggaaattttcttgctctgtagagttgataatttttttctgcctgtgtaatattttgtctaattggtgaaacataatttatttgaacattttcatggagtcagatatgtaagttttttaaatgggattctgctgtaaagggtactgctaggattagcagcttcatgtataaagcatttttgcttctttaaaataaatttccaggagaggtgttactagatcctagtgaagataattttagttttatttgatccatttctaaaagaactccttcaatttactatgttttgagcagtaagccaatattctggcatcaccacatgatggttaatatttgagtattgccattcgtgctgtctctcacaaaatatttatgccaagccatctcctaggaattgggaatacatcagtgaacgaaaacatggagaaacatctgcccttgtggagaaaataaaagtgtctatttagtatggtccaaaataggccatagaattggttctaagttacattctttcaactgctagtgagaattaacatttttctatgtgtttatttaccatcagcattcttttctgtgtgaattttctgcatattctgaagccagtcttcaacgcagagattccatggtcattgtggcctacgtgacctaaacaaatcattccaaaattttaaatgggctgagactgttgacagtcatctctgctccttataccctcatccagcatttgtatttcaggtatctggtgacacagatttctggtaatgcctcacatctgatcatcacttcctgaaaaagataaccaaaggcaatgtaataggaatatcagcagccacagcactcagtcacccaggggaatctacatgtttaagctttcataccctgttcggtttcttgtagaactcactcaacacctggagtggattaaatagatgatgtagatttcaactgcttagaaatatccatttctgccacatttcctgctgcctgttttacttctgtggagttatttagttgtcatgttggatgagtctgagctattttcccagcacgctgtactatagtgtgagtgcaccttctagggaaaagggcacagactgaacaacttatcatcagaatctgtgttgactgaaggaaggatggcaacagattcctgtcagatgattttgcctcagacaatttggctgtgaatgctcaaagaatgaggaataagtacccagggcatagagcataaaggtgagtgctatttatcattatataacatcattttgatgacaggaaaaattgaagtcacactagggacctacagccatgttagggtagatgattgtacataacacttctctcagtcctaagaacccctatgctcggatgtattttgcggactaccgagtccatgaaaaaaaaaacagtggaaacgcagtgaccatcagcatgacaagtctcctgcaaagtgaagacaaaagaccaaaatatactagctgaacccactttcctctgttgatattgagatttctgtctacgctggatagctgaatattattcatattttgcatcaaattagtaaaagtgttatttttaaatgaattttgaaggccagacatggtggctcactcctgtaatcccagcactttgggaggccaaggcaggcagatcatttgaggtcaggagatcgagaccagcctggccaacacggtgaaagcccatctctactaaaaatacaaaaattagctgggcatgggggcaggcacctgtaatcccagctactcgggaggctgaggcaggagaatagcttgaacccaggaggcagagattgcagtgagccaagatcacgccactgcacaccagcctgggcaacagagcaagactctgtctcaaaaaaagaaaaaaaaagaatattgaataatgtatctgtccagccctctgtcttgacattttcagcctgtgtgtatgttcatctgctggtgttcctctcttgtcccgtgtttcctgggcatttgtgcatttactgctgcttctgctgtaaagatgcttttatcttcttctgctggatagctcctgattactctgaagcacagcatcctctgggaaggtttccctaactctcttctcatccctgtctccctttcagttatctgttgacacagcaatgtgtactgtttatcatatcattctgcattttaatattttattctgttgcctctctccttcactgtactgagcaacttgagagaaggaaatatttattttatcattgtatttcctggaaccaactatactaggttctgataaaaaatatttgaaggaataaatgacagaaaaaagctaaagaagtaatggctttcagacaatacggcaattttcacaacagagggagcagagccatgttaacaaaaagcctagtgtaaagtgattgagtgattgctcctctctgaatcttctcttataatttccttgcagacctttttaacaaatcttctttcatcaactaactgatgctgtcataatcattcattagctgctttgtgaacctccacaatatagcactctgcttaaaatgaacagggagtcaccaaacttagcttgtgtgatgtcttaatagaaaatcaaaggaagtcaattaataggaaaaggcaagtataccctttatcttttagtaaatacatgcatgcctgttattacctcaggtaaattgtgattgagatgttggactggagctgatttataataatgcagtcctgatggaatgatgggattagagtaggattttttgtctctcatttgttttctatattgctaaggcagtatatgtcagattaaagactttgagtggacggaaacggtgacttacgcctgtaatcccagcactttgggaggttgagacaggtggatcacttgaggtcaggagttcgagatcaccctgaccaacacggagaaaccccatctccactaaaaatataaaattacaaaattcgccaggcgtggtggtgcatgcctgtaatcccagctactcgagagactgaggcaggagaatcgcttgaacctgggaggcagaggttgcagtgagccaagattgtgccattgcactccagcctgggcaaccagagagaaactccatctcaaaaaaaaaaaaaaaaaaaaaaaagactgagccattttttgttttcttagctagcatggcaaaagaaaaactttgtgtaaattatcagattaagaagtgttatcatttacactcagataaattaacaacgcagggaaaaaaaccttaaaagtcaaaccaaaatacccctaaccatcagattcagtatgaaacattgacgaagtaagagaaaaaattctggccaagcgcagtggctcacacctgtaatcccagcactttgggaggctgaggcaggcagatcacttgaggtcaggagcttgagaccagcctggccaaaatggtgaaaccctgtttctgctaaaaattcaaaaattagctggacatggtggcaggtgcctgtaatttcagctgctcaggaggctgaggaaggagaatcacttgaacccaggaggtggaggttgtagtgaattgagaacacgccactgcactccagcctgggcgacaaagtgagactctgtccctcccccacaaaaaaaggagagagagaaaattttatttgtgggtaataacccaggaaatataagtaaaactatttgaaacaagtggacaattcactaatgtagtggtttactaaacatgtcaaaatcatgagcttatctttttcttttaaataaattttattgcatatatttgaggtttacaacataatgttaaggagtacaaatagcaagatggttattacagtgaagcagatgaacaaattaacatatctgtcatctcagatagttcttatttttgtgataagagcagataaaatcaacttctttaacaaaaattcctaatactatagttttactaactttagaactcatgatacacatgagatctctgaacttgatcatcctgcatatctgctattttgtatccttcaacctagatctccctatttcttctccctccctcctcctgcctgtggtaacaactgtttcattttctatttctgtatttgagctcttaaaaatattccacatataagtgagatcataaaatatttttctttctgcgactggcttattttacttagcataatgtcctccgggttcatctatgttgtggcaaatgacaaaattccttctttttaatggctgagtagtattccattgtctatttctaccatattttcttatccatttgtccatcaatggacatttagtttttttccatatcctggctattgtgaatgatactgcaatgaacatgggaatgtagacatttttatgaggtgcttatttcatctcctttgggtatatgcccagaagaggtgctgctgggtcgtatggtggttctatttttaatttctttaggagcatccattctcttttccataatggccctaccaacatacatttccaccaattgtgcatttgggttcccttttctcagcatcctcaccaacatttgttattgcttctctttttgataatagccatccttacgagtgtgaagtgatatctcataatagttttaatttgcatttccctttgattggtatgagcaccttttcatagacctgttggacatttttgtatctttggagaaatgtctgttcaggtactttgtccatttttttttttttttttttttagcagaatcttgttctgccacccaggctggagtgcagtggcatgatctcagctcactgcaacctccacctcccaggttcaagagattctcctgcctcagcctcccgagtagctgggactacggttatgtgccaccacgcccagctaatttttgtatttttaatacagacggggtttcacggtgttagccaggatggtcttgatatcctgacctcgtgatctgcctgcctcggcctcccaaagtgctatgattacaggcatgagccacagcacctggccttctttgcccatttataaatcgggtttttttgtttttctactattgagttgtaagagttctttataaattttggatgctaggcccttgtcagatatgtggtttataaaaactttcccagtccaggccaggcacggtggctcacgcctgtaatcccagcacttttggaggccgaggcgggcagatcacctgaggtcaggagttcgagaccagcctcaacatggagaaaccccatctctactaaaagtacaaaattagctgggcgtggtggtgcatgcctgtaatcccagctactcgggaggctgaggcaggagaattgcttgaacctgtgaggcggatgttgtggcgagccaagatggcgccattgcactccagcctgggaaacaagagcaaaactccctctcaaaaaaaatacaaagtaaaaataaataaataaaaaaaactttcccagtccatacgttgtctttcagattctctttaaattatttcttatgaggaaacaaaaatagtcaatttatagtaatcagggcaaagttatcttttaaaaatacatgaacatgattagctactttaaaacaagttacaactttagactttggctttttcataatgtaatgccaggttctcatgaaatgataatatgataggactgttcaaactaggatactggcttcattctttcctttttaaattaactcaggcagtgtatctaaaactaaatgccgtgggcccttgttttgggggctttcttagttttctctgccaattacggtttgtgtttttactatgcaacattgttcaacaggaacaagtttaaaacatttagtatccaacaagtgctaaccaaacaaaagtgaataatggaattctaggctttgtcccagctcctcccattctctcctcaaggatgacaaatgcttaagtaataagaatcaattttgtgagtaatttttgagttccatctgattactgttaatagtcacaacttgaaagcatgagaatacatttgaaggcaaaaacttttgctacagcaagtttggtggtctatgctaacattcctttaactatttccaccagctttaccataatcatatgatagaatgcatgctaacacaagagcttgctgcatataaaacatgcttgagactaggccaaatacataatccaagcatttctattctatggaagatttcttttcctttaagtttttgttattttttgtgttttatagtcaccatagaaattgtagtatacacaaattatatactataatacttattgcagtctccacctatttctttaaggggagaaactccccaaacataaaagcctgcagttttgtgagttttgacaaacgtgtacacatatgaaaccacgatcccatcagaataggatgtgattatctctggaaaatgccctcatactctcttctccgataattaccaccccttctcccaacctttagagacagccaatgttatgattttttcccaaaccacagatttgcttataatagaactgtttatattaatggacttacagagtatgtactcttttgtgcctggcttttgctacagataatgtctgagagattcttctatgtccttgaatgtaatggtaggttcttttttcttttattttttttcccgagaatttttccattgaatgaatacaccaaaatttgtttatgccttgtcgtgctgatggacattttggttgtctatagttttcagctattataaataaagctgctatggacatttttgtacaaggtattgttctcttggctaaattagttctcttggctaaattagtagggatgcaattgctcgaccatattgtaagtatatatttaatctataagaaactgccaaacctttccccaagtttgttgtaccattttacattccaaccagcaacatatgagttttccagttgctccccaacctaatatactgtcaggtatttaattttagcaattctcatccatgtattgtagcatttcattgtggctttcatttgcatttccctgataattaatgaggctgaataattttaaacggtgccttttagccattcatacagccttttgaaataatttttcaaatcattttaaaattcaaattttaaaatttgcatgttcattttaatagagtcttttgatgagcagaagttttaaattttgatgaagtccattaattcttttcttttatggttattgcactctatgtcattcttgagaaatctttgtctaacctcaggtcagggagatattatcctatgatttcttccaaaagatttctagttttagactttgtgtttggttttatgatccaccttgaattaatttctgtgcatggtacgaagaaggagttaaagttcattttttttctctcctggcatataccccattgtttaaacactatttgttgataagaatatccttggatttcaggatagctaaagacaatggtagttgcttaggttcctgtctcccaacttttccccccaaaataacacagaaaaacaagaaggtaagaaaagcaaaaacaaaataaacctatcccaaaacaatgacctcagcattatgtaaagacagagaatgctcatatctcaaaataacttgaaattttaagaataaaattgtaaatgtccagtaagcaatctcttgctgtcctatcctactgtaagtctttgtggcaagaaaaaacaggtcatgaaaaactatgggaagagaggagagagaaaatgatggccataagattgaccttaccaacttccaaaagtaagtctgcaggagaaaagaccagagcatggtttgcagggaagggacttaacagcatgtatgatgtgaagtgacagtttttgaaacctatagcctctgtaggagaaaaaatcaaaacagaaagaagtgacccttagaaattagatggtcaaaaagaatgtagcaaagggataaatttttgagtagttcatgtattacaaaagacaaacaaaatacgaggaaacaaacaatcccttttcctccactgcagaaataacccactaaggaatctggactttgttatactgaatgaaggtagtgccaccgaagcaggaatcttgtaaagttcctcagtactacaaacatatgaaactgccccaatagtcccatagactgttcttttggataaacatagaaattaacctttccgatcttaaagcttcaagcttacatttgttttctttgaggaaaggaccttctggcctctttaaaaaagcatcaaaaaaccgaatctcaccagatcaccacatcctcacaatgagatgacaggcccctcattcattatgattgcttcctagccctttcctagttcttgaacattgttatatttctttcttgctatataaactcctagttttagtcagtcagggagatggatctgagactgagctcccatctcctgtagcacctaattaaagccttcttccttggcaatatctgtcatctcagtgattcgctttctgtgcagtgagcagcaggacctagatcaaaccctgtgtgttttggtaaaaaatgaaataaataatacagagttatgaaaaattacaaaatgaactctgatatgcctcaactagggaaaaatccttccctcaaaaacagaattcatgagccagaagagatgataatccctcagagtgataatttgttgtacagtttgtggacttaaaggaatttactgtttagcacattttaagttttaattttttttttttttttttttttttaagaaatagtgtctcactgtgtcactcaggctggagtgccatggcaccgtcattgctcaatgcagtctcaaactcttgcgctcaagcagttctcccactttgacctcctgagtagctggggccacaggcacgcaccatcatgactggctagttatttatttatgtatttgttttgtagagatgggggtctcactatgttgcccaggctggttgaactcctgggctcaagcaatccccctgcttcagcttcccaaagttctggaataaaggcatgagccaccaaacctggcctatttagcatgtcttaatattgtccttagtatttaatcttttaaggactctttgcatatcttaacctctaatattccattcactattgtctcaagttaatacaatacctgttccattctattttctaggacgataatgaggtttgatgattttggacttcaaagaaaggggagaagaacatatgtattgtgacttggtacaaaatgccaaataccttctaacagtaatgtcaattttcccctgaaaatttggtcaaaagattgaatgagtggccagaaaagactctaatactggaattagaattccaggactataaagaggaagtctcacataggttaggatatcacaattttacataaaataaactgggcagattttcacctcagagaactttgaaaattatgctaatgctaaaatttgaaagctatttatacattaaggggaagatacaaatctaggctgtaaaggattaactactgtagatgcatatcggaattacaacactgttagttccaaagggaaaccaaagaagtttttatacggtgtgggagtacatgaatgtttactaagaatttgtcagcattatataatactgactaaatgatagcctccttcctgtatttggaggacacagatgttcaaatcactaagcaatgtgctcttcaaggtggatgggctacttaactcaggctgtcaggttgcctaagtaaccattacgtaagaacacttatcttcctgtgctgattcaacatacgttaaacaactgagactaaaaacctactaggatgtgaacacttgaaggttgggtttctcttatttactattatattaatgccaggacagtgtctagaaactagtagacacacaaaaaattagttcatgaaacaaagaaggcttatatacagctgctatactttttatcttgtattccaatacttggcaaatactagcagttgaattaatgtttattgaattgaattcctaacttgcattccttgaaatagtaggctaggaactataaaataaaaatagacatgtaccagctgggcgcagtggctcacgcctgtaatcccagcactttgggaggctgaggagggcggatcatgaggtcaagacatggagaccatcctggccaacatggtgaaaccccgtctctattaaaaatacaaaaattagccgggcatggtggtgcgcacctgtagtcccagctactcaggaggctgaggcaggagaattgcttgaatccaggaggcggaggttgcagtgagccgagattgcgccactgcactccagcctgccaatagagcaagactccatctcaaaaaaaaaaaaaaaaagaagacatgtaccataaagtgttagaagtcgctgatagaaaactacatgtttttttgtgggaatccaaagatatgactttaaatattcatctgaactcacttattctactggtggttttcagtaactattgaatttaatttttgatattaaaggcatacttattggtattcctgaaactattttgatatttcccagcccacaattgtatatctagtaaaattaatattttaaaatctgatctgctcatattattttaatgtaaaaaggattgttgattttgagcaatcttttccactcttgtggctttataggccagatggtgtataaagcttgttattctataagcttagtgttcttcaaatatatatctttaatttacacttctctcaagctccagactcttaagtcctacagaaaaatcgacatattaactttctttcttcagaaaacatatcatatgtgccctgtgtggaatcggctatcctcctttaactttctcttcagggcctagtgtctctgctcattcagagcttcaacagccagtttcccaaagctagtacttttcagtgacttttcagtgtttccatcttactctccactgggcctacagtaaaatatatgaataaaaagtaatgtggtactgagaaagtgagacggcccaggggttagtgcaggctttgccagtcactgccactgtagcctagtgcgtgcccacagtctcactgctcccctctttaattatgctaaaagtcagatgtgccagtggataattgctaggattctgtgaaaggaaaataaatcttggggcccccaaatcactaagctaaaggggaaagtcaagctgggaactgcttagggcaaacctgcctcccattctattcaagttatccctctgctcactgagataaatgcatatctgattgcctcctttttaaaggctaatcagaaactcaaaagaattcagctgtttgtctctcacctacctatgaatggaagccccttctctgcttgagttgtcccacctttccagatggaaccaatgtacatcttacatatgttgattgatgtctcatgtctccctaaaatgtataaaaccaagctgtgccctgaccaccttgggcacaagtcatcaggacctcctgagtctgtgtcatgggcatgcatcctcaaccttggcaaaataaactttctaaattaactgagacctgtctcagatatttgcagttcacattttggtaaccacgaagggattctgagtgaaggtgcccctgacctttgacaaatctcctattggtgcttggtaccagcttgagctatctttgtgggtctaaccaataggacaatttgctgaggcctggaagtgctccctccagagcatccctgatcttccaatatttggtcaagatctaaagtttattgctgtacaactcttttttttttttcttggagttttacttgtttccaaaacaaggaaggcaagtttttcctgcttccatgacaatggaaggcaggtaactcctgtatggagtttgaactcacttccaagaggaaagacaaatttgagattttcctgcttctaggatggtagagagcagtcttaagtctgagacctatccctgggtgagtaactgaattggtgtttgtcttggctaaagttaagattttagccaagacaaaccagctgatcttaatttcaccttaccattaacacactccgtaatcttacaagttgcgccattgtttgttttgcttaatttttgttgttgttgtttgcttgtttctgtttttgttgttatttccatattttctccattgggtttgatcaactctgacttgatcaaatacaaaggaaagttccaaattatgaggaacaaggcctctgaagtggctaaattcccataagaaaacaatgacaacaacaaggtggtgtggtcgggggcggggggagaaaaacatacagcaaaaggaaaacagaaaggagagattctgcttttgattactcgaggggctttatttacatagcaataccacctttttgctagccaggccaaactgaaagagcaatggctgttgccccatgctgcagttccatagctaagagttctgccttctatttttccaccatgacagcctgggtttggtgcctaaatcaagccctttctgtttggatacttggcacttctgaaacagcagcaatttgtccgagctgaaatatggtaaatagattaaaacattttttttgaaggagctcagtggttaaaagtcagcttaattaaaaactaacatccaaaatgtgtgtgcgtatgtctgcatgtgtgtgtttttgtatttaaaaggccttcaccttttttattttgtgtgcgtgtgtgttttgtttttttttttttctcttaggactttgtctttttcatctcatttgactgaattatgtttccttcatttacttctgctgtctctcctttctcttgcaccctgtgctgcatgagggacctaaaatagtttataatagcctggggttccttaaggaaaatggagaaggtgccagactctcttttggggaaaaaccactgtttttacttatggaactccaagagtgttttccaaacagacaagttcatctcagctcttaaactgcttgcttttgtattatgttaccggattttttgactaaaataattattgcaatagaggttactcttgggtttttaaggaagtaaagtttagatacttgtgttacctgattttttgactaaaatagttattgcaacataggctatacttgggtttttaagaaagtgaagtttaaacaaatgtttttgtttaaaaaaatttttttaaagtgcactgtaaaagcatcacgaggtctagcttcataataattctccctttttagagatccaggattcagtgtggactctgcccagagttcagagatccagttagaagatagatagtccctatctaaataaaattgttctcctcatgcaatcctgtgatagatttctacaattttatgtttgatttagcatctatctttaatctccctgtagcatcaccagaccttttttctctgtaccttgagatgtaaattttgctaatctgatttttaatctaagagttgtttccttcaatatgcaaatttagggctgtttacctgacaactgccaggataatgaatcagtttatcaagagtttgcaagtctaagatacggaaaaaaaaaggaggtcgtaggaattcataaagtgtatttttatcattatgcctaacacatctatgtatttgtgtgttctctacacaatatttcactactaaaatatataaaagagctcttattaattggcttcaagaaaaataaaagtccttaaatcaaatacttcatcggagaaaaaggaaagactagtcaaatgctttttcaattttatgtgacttaagtaaaatctttaataaataaggtagcttaaaattattagtaaagtagtattagaaatgtcttaaaaattattatcaagcaattgcatacttatccctgccaaatactataaggtgtcaaaatttggcatagggtttataaaactataaacacagcccaaaatggaatgatctttcttgtgtaatttttaatagataagatattgatattggtttaatgaaaatagctacatctcaaattatttaataaaattaccacaacccataatcttctggctttaggcagtccagaccacaggcaataaggaggtttgtttgtaagaggactgttaccatcttttttcaaagctaaactataaactaagttccttccaaagttagttcagcctatgcccaagaatgaacaaggacagcttggaggttagcagcaagatggagtcagtgaggtcatatcttttttaatgtctcagttataattttgcaatggggagtttcataactttaaatgatgcctatcacagttttcataatcttggtaaatgattaaaataaaataattaggtaaatgtaatgggataaacacttgtaaacaaacttgtcataatttagaatcaaaatttatattaaattaaataatatatatttcattatttgggtattttccaataaaaatatattgtaggaaaacattctgtctaaaaaacaaacaaacaaacaaaacccaaaaaaagttaatatgatcaagttgtctataattaaagggatttatagtggtctttctagagattaaatttgatgataaaaacacttatacacaaaagaattgattagaacaataaaattttcttaaaggattgatttactcttaatgaattataagagattttaatttgttttaaacccaaagttcaacttgtattgtttcttgatgttttctgttttctcttctcttttagaaagtgcgaaatagtaatgctcttcttcaacttattttcagatcataaaagtttttattccttcaagttctattcgctgtgggctgatgctagcaacgttttctttctcttttttttttttttttttgagactgtgtcttgctctgtagcccaggctggatggagtgcagtggtgagatctagattcactgaaatctccacctcccagattcaagcaattctactgcctcagcctcctgagtagcagggattacaggcattttccaccacgcccagctaatttttgtatttttagtagagacagggttttgtcatattgacatgcctggtttcaaactcttaccttagatgatctgcccgcctctgtctcctaaagtgctgggattacaggcatcagccactatgcctggcctaacaatgttttgttaaaggcctaaaggaaacgttttctttcaacataatattctgtgcactgcaggtcttttcctctgtcttttgataactggcctaatagattttatgtttaatcaaagtaattcctatgccattattattaagttttggtttgcctaaaaaaaaaaacagatgaaatttttttaaaaattaaagttgttatatccttgtatctttctgtatgtgcctttaaggttcttgtgacattgagctacaaggatttgactcctgagtctcaaaaggacaccaagtactgccaaatctcaaactctgacagcaattaaagcctcatctgcaggccctgtagaagatgccaatcaaaataaactgtgttcctgagacacaggggcagaaattaaagctattcaactcctcaaggccaagggattatcatggaagaggtgggcaggcgagaatgtaaaggccaattttgagagataaagtaaattcattttctctataaattaactattaacatcaaatgcacactgatgaaagaccagcatataggcccctgtgtcagagtaacaaggttttcttgaagcatgaattaactccttaataaaagctataaaggctataaaagggaagttgtatcttatgggtcaagatgaaaattttatagattgtttataaaatattggaaaacaaatataattgaattcatgctgtttttattggggcttattggctgaaaaattaagtctcctctttcaaagaatgaaggtttttgccattttttgaaatccttcaattaccattttggttaaatgaatgatttattttacattgacttgtgatcctattttgtgatatcaagtgttttaaacctttgatatttgacaaactttccaaaatcaaattataaattatgtatttttctgacctaattaatcctttaagatattaggttccctaaagtccaaaaaatgacatatttgtcttatttggtgtaaaaattatacaggaagcattgtaaaatgtgaaatggtgtttggttttctttgggctatatttgtataaatatgttattggtatatgttccaaaattatgagaaactctttaattctgatatgacttagtgtacattaccagtaataattataattgttatattaaattattgtataccacagaggaaacaaatgtccttgtcaattgtgtctttgactatgttttctctaaaacattttgtcatccatagatgtattagtcaaggttctctagagggacagaactaatggaatatatatatgcatgtatgttaatacttaactaacttatggtaagtcttaactcacaccatcacaaggtcccacaataggccatctgcaggctaaggagcaaggagatattcctaggatcaatactttgtatccttcaattcaatcaagtgagcattcagtattaaccatcacaatggacaattgctttttttttttttttttaagatggaattttgctcttgttgccgaggctggagtgcaatggtgcaatcttggctcactgcaacctccacttcctgggttcaagtgattcttttgcctcagcctcctgagtagctgagattataggcacttgccatcatgcttggctaatttttgtatttattgtagagatggggtttcaccatgttggccaggctggtctcgaactcctgacgtcaggtgctctacccaccttggcctcccaaagggctaggattacaggtgtgagccactacacccagcctttggtcctcattagaagctggttttataatcacctataaagccctaacaggttctctcgaatgcaggtttctgataactatggagattgtgacatcagaatagaggaaaaactttcaggtctcacagagagctgaaatgttcatgaatatcatgcagaacaggaattacctgcatgaactgaactaacagaagactgaactaatctttttgacttttttcttaaaatgttcttgatccttcgttttgtttttcagagccaaggaaatttttttgagctattgacatcttttaacaagttactatactcctatgaacaaaatttggaacatatttgtttctctctacctgatttctccagaatttggaaactacttgtgagtattctttatttatggcaatatagttatttgcataagtgcaagaaaaatctgttttcaattgtaacaggacacaattatagaaactggttattttaccaaggttttgactgaaatggtgtgctttcctttaaggaatcaaactggacttatagagcaaataaaaatcccttgggaaaactggcctcataccttgtctacacagttcctgtacagggttcctgaccagtggtaagtaaagaatgccactttctgacaggcccaggagccccaagttatcttggggcctcagggcctgggatgagaggggctgtagtgaaaacctctgacatgccctggagacattttccccgttgtcatggggattaacatttggctcctcactactttagcgaatttctgcagctggcttgaatttctcctcagaaaatgggattttcttttctatcgcattttcaggctgcaaattttctgaacttttatgctctgtttcccttttaaaactgaatgcctttaacagcatccaagtcatctcttgaatgctttgctgcttagaaatttcttccaccaggtaccctaaatcatctctctcaagttcaaagttccacaaatctctagggcaggggtaaaatgctgccagtacctttgctaaaacataacaagagtcacttttgctccagttcccaacatttcctcatttccatctgagaccacctcagcctggtctttattgtccatatcattatcagcattttgggtgaagctattcaacatgtctctaggaaattccaaactttcccacattttcctatcttcttatgagccctccagactgttccaacccctgcctattaccccgtttcaaagtcaattccacattttttggtatcttttcagcagtgccccactctactggtaccagtccattactgtacattaccagtctattaccagtccgttttcacactgctgataaagacatacccaagactgggcattttacaaaagaaagaggtttaatggactcacagttccacatggctggtgaggccttactatcatgacagaaggtgaaaggcacatctcacatggtggcagacagcagaagagaatgagagccaagagaaaggagtttccccttataaaaccatcagatcttgtgagacttattcaataccatgagaacagtatgggagaaactgcccccatgattcaaatatctcccacttggtcccttccacaacacaagggaattatgggagctacaattcaagatgagatctgggggtagacacagccaacccatatcaccattcatgagggatccactcaaacacctcccaccaaaccccacctcccacactgaggatcacattacatcatgagacttggagtggaaaaaaacatctaaaccatattatcaggtttaacaaagagcagcaattctggaaaagtaactaaattatgtggggaggctaatgaaagataagaattattttaacaaagtctgtttgtacagaattctcttggctatgattctctgtcaaatatttttttctcctggtacagagagggcattttttacatggcagtttttatctcctgtttttaggaagaaaagagaagattagaatgtccttttgcttctgctgtttatcaagtgcctttatatgaaaaaaatccttatatcaaagaggtatattgggggtaggggaagcatattcttccaccctccattggtttataaatatccgtggcttactgaaatcttaacaattagaccatttctgtccttgttatattattgggctcctaaagcatttagaacatccttcttttgacaaagctttttatttaagtctataatcttattgtagtctcgaaagtctcctgtatctgaagcccgaatattcattctatttaccttcacattctttactaggaatctgaagccaccttaaggcaaaggaatgacttccatggaatacagatgaagttggtaaaaggaaatacaaaggagaaaaagtacatttgttctgttctatgactattactctgatacactggtaatgctatgatgatggaaggaacaaataaatgtctcaggatcttgatcttctgataatagagagggaagttaacagttcctgtatttacaggaactgtaatagagagggaagttcctgtatttacaggaagaattttagcagggtaaacttcaaaaccagtaaaggcttgcgtgttgctaccataaaaaagaacaagaaagccaaccacaaaaattaaacactaaattgagcaaagaaagaaaaggcaatattactactgaagtattagagagcactcactacttccctattttacctgcatgtataacctatgacgttactcatttatttctctgtatgtcatttgagaagtgacttatggagagagaatagataaaatagcattccttaattaaatatggtaggatgcaacgtatacatgactaatttgggataatatttcttgtgtgtgtgtgtgtgtgtgtgtgtgtgtgtgtttgatagagtctcgcactgtcgcccaggctggagtgcagtggcacaatctcagctcactgcaacctctgcctcccaggttcaagtgattctcctgcctcagcctcccaagtagctgggattacaggtgcctgccaccacgcccagctaattgttttcgtatttttagtagagatggggtttcactatgttggccaggctggcctcaaactcctgaccttgtgatctgcctgcctcttcgtgtgtgtgtgtgtgtttcttttttgtttttgagacagattttcactcttctcacctttttatataaagaaaatgcatctggaacatttagatcagttcttgaccatattaaacaaatcttatagaattaacacaaaccatgttatctaaatcttgggattttgagcctaaaagcctgtgccttaatttataatcaaaggtcaaaaaggtcagatctataaagagaaggtacaatgatgaacactaggtgattgctttgaaaactttcttgcaaacgtagcttacttggggatttttgttaatatatctaattccgtaagcctgggtgaagccttggattctgtatgactcaggagcccttgggacactgtagtgctcttagtggtagagcaccctttgagcaggatactgaagaagagctatttgacttgaatggcctggctgggtttccaaattttctggggtgttcttggacttctatttttctaattcacttatgtagcatcgtgaaaagttttctgaatattctcattggaatcacgttcaacttctaggtaaatttgagaggaaatagaaatatttacaacagtgaatcttcctacttattaattatgcctttctcaagatatattcactttgttttatgtccatctgttagattctgtaattttctgaatagcagttttgtacatcattttgcatgttttgttcctaggaactctatgtttattgctggtatcacaaatagaatcttttatattattatattctctaataggttattgatgttgtgcaaaagcatcattgactatattgatctctctgcagagctcctgctaaactctaacaggttgtctatacatatttttgaatttgtttatgtagacaaatgtttacatataacagttatgtctcttctttttttaccctgctatccttaatttcttttacttttttcttttattggcaaggaaatttcagcgcaatgttgattttttaatagtggtagtgaccattgtttgttgccttctcttaatggattatgcagttgtttctagaacatataatattattttccaccttgagaaattttctgatgcccatttctctgccaggaatgttattttgtccatagtcctcatagaactgtttccttcacattaatcataccaaagattccgtgccaaccgtgaaaaattgttgattctttcagtatagtgataaaagaaccaaacacaaactagctaaaacaatttaagggaaatttattagcctcaaactaaaatgtgcagaagtagattcttgctgtcatcacaattgtatttggtattgatggctccatttctttctaaattcttgaacaaattccctctaagttgcaaatttgatagcagcccacttcttacaagctaagcaactctattaggatgggaacttcttcctacttaaagttaagcttcctccctggttggccttgcttggctatgtgctcatcctcaaactaatcactgttgaggagaaaggactcataattctctctctgtggtaggcagagtaggccccttgaccaagtcttaccaaaattttctaagcactgagaacaaatagttcacggatccatgagatgcagctggatagagcaaagcatacgaaatccactaaatttgcttaaagacatctttcctgacaagcccatttttaaattctgtatctaagctcttataaactattatgtcatgaatcctgatttgtaatttattaatttatgcttcctgtactagaatataaactccatgacagaagggacactgctttccttgtttactgttgcatctccaggatagagagtgatgtatgctgtatgggaggaattaaataaataaacttaactgaaaatatcaggaatccataacagggaaaaataacattccagtttgtactaagagacggtgatattgaatatgataaccttaacttccttttgaaatgagttgacaagaaaaagttgaaaattgtctttttgcttctcttttttaagaagtcagttgccaattagatctacttgcagcctggaagagctatgactcaccgtgaacttgaatgaatgaagtctttaggctgatttttacacataatgtcaaagttctctttttctggtcgtagctacaccttgccttttataagtattaattattaatacattttcatacatgttgtttatttggtttaaattctatctctgccatttgggaggctgaggtgggcccatcacttgaggtcaggagtttgagaccagccttgccaacatggtgaaattgtgactatactaaaaataaaaaaaatagctaggcatggtggtgcacgcctgtaatcccagctacacaggagacggaggcaggagaagcatttgaacccgggaggtggaggttacagtgagctgagattgtgccactacactctagcctgggtaacaaagcaagactctgtctcaataaataaataaataaataaacaaagagacaaacaaacaaattctatctctgccacttacctgctatgttatctcaggcatttttttccctcatttccagtggggttgactatttctggcattttactcaacttctctaaaagctttcattttcttgtctgtaaaaatggagtcttaacctctactcacattgtatcataaagattaaatgaaataatgtattttgaaaaaccagtacaatacttttcaatagtaacaattaaaaatgatcattatgattttatttgtttctagctttttgatatagaatatctgttttgggcagaatgcatgccaaccacaataaaggtggctggatttccttacctgcccttcatataaagttacctttgacatgtgcagagtaaatatagtaccttcctgtgcctttaagttagcagtattttgcagttccctaaagatcatatggtagaagcaacagtgactaaggagaaaaggaaaaaacaggttaggaccattttctcaaaaggtgatagtgccaatggcaggcacccaggcttcttgaactcacctatgttcacattgttagtaaagtagcagaaggaaggcatgctaggagttgaacttcatgttttccactaactatcctaaagtcaatccttctaattgtatggagtcctaattgagaaaaagagtcaggctggctcctttccaagagaaagcaaaaagaaggaagcagataagctataagtctgcctttttttcatggtccagggcacatagctctcctgtgcaaataactaacaatcttcctgcacccagttatcaccagatcctcggctgataaaaaatacatgttagctcactgcaaccttggcattatcaatactgcacaaaaccctcattagcacacagcacaagcaccctattccccagccagcctttatctccttgcagtcagctcctctcttgctagtctgcctgttgctcccttgtaatatattttcttatcttctctaataaatctgccctcctttacctattactgttttggtaacttcttatcacctgcaccattggcccagatagtcaccactcacctatgacaaactggcttgtaaaataatttctagggttattatataccaatatattatataggtttatcatgaaagatggtagtttacctttgaagtagtataaaatatgccaagcaaaaaaaaaaaaaaaggtagaaataaacgcaggtgtctgagcagcaggcacggtctgagctatccagatctttgtgactgaaactttcctttaggcaggtccactccttcacctaagccacatgctctcttacattcttgctcccagtgtcatgcccttgatttgtccttctagaactttctatgtgaaaatattcaaagtacagtgtgaggggagctcaaatagtaggggaatgcaggaccccacttttgtagggagaacttcatgagatgtcaaagcccagtaaagtgaaaggtagctagaactaaagggctagagggaggcaaatattgctgaaagcctgcatttagagacagagaattgcaggacaaaggagacacttcatacaggagagctctggctggcatctggcaggtgcactctgggatgaagcttccagaggaaagatcaggcagcaatctttgctgttctgcagccttcgctgctgatagcaggcaaacagggttgggaatggacctccagcaaactccagcagacgggcagcagaggggcctgattgtcagattgtcagaatgaaaacaaacaaacagaaaggaatagcacgtccactcaaagaccccatctgaaggtcaccaacatcaaagaccaaaggtagataaatccacaaagatggggagaagccagcacaaaaaggctgaaaattccaaaagacagaatgccttttctcttccacaggataacaactccttgccagcaagggaacaaagctggaagaaaaatgagtttgatgaattgacagaactcggcttcagaaggtgggtaataacaaactcctccgagctaaaggaacaggttctaacccaatgcaaggaagctaagaaccttgaaaaaacgttagatgaactgctagctagaataaccagtgtagagaagaacataaatgacctgacggagctgaaaaacttcacttcatgaagcacgcacaagtttcaatagccgaatcgatcaagtggaagaaaggatatcagtgattgaagatcaacttaatgaaataaagagagaagacaagattagagaaaaaagactaaaaaggaatgaacaaagcctccaagaaatatgggactatgtgaaaagaccaaatcaacatttgattggtgtacctgaaagtgacgaggagaatgcaatcaagttggaaaacactcctcaggatattatccaggagaacttccccaacctagcaagacaggccaacattcaacttcaggaaatacaggagcaccacaaagatactcctcgagaagagcaaccccaaaacacataatcatcagattcaccaaggttgaaatgaaggaaaaaatgttaagggcagccacagagaaaggtcaggttacccacaaagaggaacccatcagactaacagcggatctctcggcagaaactctacaagccagaagagattggggaccaatattcaacattcttaaaagaatttcaacccagaatttcatatccagccaaaataagcttctccttcataagcgaaggagaaataaaatcctttacagacaagcaaatgctgagagatttttgtcaccaccaggcctgctttacaagagctcttgaaggaagcactaaacatggaaaggaacaaccggtactagccactcaaaaaacataccaaattgtaaaggacatcgactctacgaagaaactgcatcaactaacaggcaaaacaaccagctggtatcataatgacaggatcagattcacacataacaatattaaccttaaatgtaaactggttaagtgccccaattaaaagacacagactggcaaattggataaagagtcaagacccatcagtgtactatattcaggagacccatctcacatgcaaaaacacacataggctcaaaataaagagatggaggaatatttacaagcaaatggaaagtaaaaaaaagcaggagttgcaatcctaatctctgatgaaacagactttaaaccaacaaagatcaaaagagacaaagaagggcattacatagtggtaaagggatcaatacagcaagaagagctagctatcccaaatatatatgcacccaatacaggagcacccagattcataaattaagttcatagagacctacaaagagacttagactcccatacaataatagtgggtgactttaacatcccactgtcaatattagacagatcaagacagaaaatcaacacggatattcaggacttgaactcagctctggaccaagcagacctaatagacatctacagaacgctccaccccaaattaacagaatatacattcttctcggcaccacatcgcacttattctaaaattgactacataattggaagtgaaacactcctcagcaaatgcaaaagaacagaaatcataacagtctctcagaccacagtgcaatcaaagtagaactcaggattaagaaactcactcaaaactgcacaactacatggaaactgaacaacctgctcctgagtgactactgggtaagtaaagaaatgaaggcagaaataaagatgttctttgaaaccaatgagaacgaagacacaacgtaccagaatctctgggacacatttaaaacagtgtgtggagggaaatttatagcaataaaagcccacaggagaaagcaagaaagatctaaaatggacaccctaacatcaaaattaaaagaactacagaagcaacagcaaacaaattcaaaatccagcagaagacaagaaataaggtcagaacagaactgaaggagatagagacatgaaaaacccttcaaaaaatcaatgaatccaggagctggttttcttaaaagatcaacaaaatagactgctagtgagactaataaagaagaaaagagagaagaatcaaatagatgcaataaaaaatgatataggtgatatcaccacggatcccacagaaatacaaacttccattagagaatactataaacacctctatgcaaatgaactagaaaatctagaagaaatgaataaattcctggacacatacaccctcccaagtctaagccaggaagaagtagaatccctgaataaaccaataacaagttttgagattgaggcagtaattaatagcctaccaaccaaaaaaagtccaggaccagatggattcacagctgaattctaccagaggtacaaagaggagctggtaccattccttctgaaactattccaaaaaatagaacaagaaggaatcctccctaactaattttatgaggccagcatcatcctgataccaaaacctggcagagacacagcaaaaaaaagaaaacttcaagccaatatccctgatgaacatcgatgagaaaatcctcaataaaatactggcaaactgaatccagcagcacatcaaaaagcttatccaccatgataaaaaaattaaatttttaaaatttagagatggggcttgctttgtcacctaggctggagtacagtggcacttggaacagtgctaggaacacacaaggtattcgatgactatcttttaatcaatgattaaatcataatcttctatgttggacaccaagcatgtgtatgcatttctacatgtgtaaggaataataaaaggagtgaagtttattgtttgtttatttttgttgttatttttatcacatatatatgttaaaactgaaatggcctattgttcattgatgtgttatgacttctatgaaagaaaaggtgccctacttcaaaaaacaaggcaaaaaaaaaattcccaaaagtagcataagatgttataataccaaacatgcacatttaattttaagtattggaaacaagaatattttgtaagtttttttgaggtatacaccagctattgtttacatgagacttattcagattggtatgaaatgttcctaattcaaatttcaaccaggatcacacttaattttataatcatgtgtcggaatgcttaaagtaatgagcttctgaaggcttacagccttacaccccattggccatgtcttaatgacaacacaatgagacttaatgtttcttttcatgaaacatccatctgagagcaacaattttgttgaaagctttaaattaatttatgccattcattatttttttttctgaaagtttagtccctttgtgccaagcatgtcgtctttagttgactgtagcatgttgttttcatgtaagcttttattttctcattcaatgtcctatgcacttagtattttccatcatttccttgttctgtcccttctgattctggacattatttctaagcagatacatgaaacatatcactcacagaattcttggtattaaccatatcatgggttacatagcaagaaaggtcaaggagattaggaacaaattaaagtttaaaaaacttagattgtaaactccataaatacataaaactgaaaattaacctgtaactaagtaataaggaagcttaattaataggatttttattagatttgctttcttggatttaatatttgataggaaaagtaaattaagcatttatatttactacttgtatactcctgtatatccataatcacacaataaaaattgtgcttatattgtcttttgtcatttaaattctcatttttcaaaacatacaattttaccaagttcttaaaaatgtccaatagtaggaatttatattccaatggctgagattattttaataattttctctgtatctttataataaacctttatcacccaaattaatccaagtgtggctttgtttcttacagtccaaatctaactaataaaaatgcaatctggttttatttcattttaacagacaccattttatttttttacaaaaataggttcttatataatactgaatttttaaaaatcaagtaaaaatacccattctccaagcatataggttgatagaattttaactatgttatgtttatagagtacttgcttagtaaattacataataattttaatacaagacaattatatgctactgccttaaaatgtccataccaagtaacaatggatatatttacatcatggacaatgtctagtacattccctggatccaatacatatattttaaaatagttgaatatgctataatattttgaccaatcatacagttatgactcaatcaaaaagcatctgaggagtataatgactgggttattttcatattacagaaggaaaaacacatgagatacacagtatctcagattgtcctcttatcagctaaatggccctgtataataggaaaaacaggagagaatataattctcaaaaatatgaggagagctggctgcagttgcatgtgcctatgatctcagctactctgaaagctgaggtggaagaatcacttcagcccaggagtttgaggctgcagtgcactgtgaccgtgcctgtgagcctgggaatggccactgtgctccagcctgggcaacaaagtgagaccctgtctccaaaagaaaaaaaaaaaaagaaactgagactcaaatatcattgaggattgtttcttttgaacactttatatctatattcaattttttaaaaatttattttctgagatgactgtcgagttacatcaagttttgagtcgtcatttttagagtcttgttaacagaattgattgaccattttagcccaaacagttgaaccatgattgcttgtagatggcgtttttacctatttattcttgcccagaagagtgctctgcaccatgtggtcccaacaatgcttctaatcattgtatttctaaatgctgtgacaagaatgaacaagagctgttatgttcatgcaatagagtattatcctaccataaaaaagaaataaaatagtgatacatgctgcaacaaggatgaactttaaaaacattatgctaagtgaaacaagccatacacaaaaggccatgtattacatgagttcattcaaatgaaatgttcagaaatagatagatcagtggttaccaatgggtaagggaaggatgggagggaatggggaatgactggaaatgcatatgaggtttctttttagggtgatgacatattttggacttagatagtcgtgatgtttatgtaactctgtgaatatacaaagacccaatgaattgtacattaaaaaaatgtggcatctgcattatacctcaataaaagtgttataaaagttacttagagctatgttttcatttcttgactattaagcattgattgattcaatatgtgtctcttttttgcaatttattaataatgtatttttttgtgacaatcatagtattaaagttgtttgaattggaaaccctttaatcaggctataattgaaatagtactctaggaataatgctggtgacagttttgagttaagataatctgtttcaataaatgttattgaagatgtgatgtatggcaaataatttatttatgtgaatgagcaaaataaaatagaagcgctatacttaagtaaacataggaagagtttttttactattattatactttaagttctgggatacacgtgcagaacgtgcaggtttgttacataggtatacaagtgccatgatggtttgctgcacccatcaacctgtcatctacattaggtatttctcctaatgctatccctcccccggccccctaccccctgacaggccccggtgtgtgatgttcccctccctgtgtccatgtgttctcattgttaaactcccacctatgagtgagaacatgccgtgtttggttttctgttcctgtgttagtttgctgagaatgatggtttccagcttcatccatgtccctgtaatggacattaactcatcctttctatggctgcatagtattccatggtgtatatgtgccacattttctttatccagtctatcatcgacgggcatttaggttggttccaagtctttgctattgtgaacagtgctgcaataaacatatgtgtgcatgtgtctttatagtagaatgatttataatcctttgggtatataaccagtgatgggatggctatgtcaaatggtatttctggttctagatccttgaggaattgccccactttcttccacaatggttgaactaatttacactcccaccaacagtgtaaaagcattcctatttctccacatcctctccagcatctgttgtttcctaactttttaatgatcaccattctaactggcatgaaatggtatctcattgtggttttgatttgcatttctctaatgaccaatgatgagctttttttcatatgtttgttggctgcataaatgtcttcctttgagaaatgtctgttcatatccattgcccactttttgaaggggttgtttatttcttggaaatttgtttaagttcctcgtagattctggatattagcccactgtcagatggatagattgccaaaattttctcaacatgtaaagagttttaataggccaatgtatgccatggcggaacttagtttgtgtttcctgtcttcgggaataccaactttacactctgcaactgggtctattgaagaatactcataattacaagaatagattagcacagagaacgggcaacccctgacatttgctgctagttccataagttttaaaccaattccattttattttggtgacacaactgataaataaagtcctcctaaatggacattttatccctcttacagctaccctcgtggttgaactatttataaactattcctttacatgcaagtggttgcatcttactattaataattatgttgtttattatttagtgtactttagggttttccccctttcccaaatgaaaccatttttcaatcaatttgtcttagataggagaagtaaactttttcctattttatacagttcctttctaggtagcttccaaacgaatgccattcttacagtcttcttaaagttttcttacacacagattgcatgctatctttatactatttctgtatgagatttctcttatcttggccacagctaatgaaaccaggagtggttatgtaaaccaaactaagtcaacttataaagtggctaaaagattgagaggtagcccagatgcaaaactctgcccaatagagggaggctatattggaatgtggccaaagcaattaaattcttgtttttggagggtctgactaggggatctactgaggaggttagcatttggtggtgagagaagaagctgaaagtgattgtagagaaactacaagtcaggtgaagactttctcctactcctctcagtagttgtagagtaggaagtagtgtatgcttgctctcagggtctaatcaggtagttaattattgctagtgttttggtgtatattttaaatgactttccagtatctagaaatactggctttcccatgcttcaatcactattatttacacaaatacttatcaagtgcctacaggccaagtgcatattccaaatcaggatacattaatgaacagtagtgcactcaccttcctggagtttatatcccaatggccaagattattttcatcattttttctgtatcttaataattaacttgtattacctgaattaatccaagtgagcatttgttccttgtagtctgagtttaacaaataaaaatgtgatttgtttatttcattttaacaggcagtcttatatgtgtgtcttttacaaatattgattcattgaagtttcatgacaatttttaaaagtatccacattttaataaggggaaataaaggcaaaaagaggtttaaaaattgcctaaagtagatgctgctagtagtaccacctattactagcagatggtgcaaacagctttttaatttaggtagtttggctccaacagtctcttaatcacttttctatgctaccttttaaaacaattttggtagaattccctttgtgttctcagtaattacatttatatggatatgattttataatccaatactcatcttttgtctcctaatttcatttttcttgaggataggtgtcctattcagtcttgaatacacatcatcacaactatctacagctagaggactacaaatactataggatgatgaggtgacaatattattggttaccttgtcaccagttacatcaacaggtactaactgttctttgaaatctttctagaaccatcaatcactgtagaagcacatattattgtatacagtgacatcatcatgaatcgcagtgatttccaaagggatatgtgcaatattaacatatcttttatatgccataagttctgaatcataggggtgaattgacataatacagttagcctccagatactacagtaattcttctgcaagatgacttacgttgttatataatatcactgagaaagttttcaatgtcattctcacctttgctatgtgtaaatctctattggtttggatacacttttttttttttcattttctttaggttgttttactacgtaaaattgtgtgaaaaggttgaaaacgtggatacttgaaacccgtatgcaacatctggttgacctcattctgcctcctcaatgtataaaagtgtgataaacaccatatacaaagtattatattcacactcattactgacaagcatattttgaatatgatttaccttcccatttttgtttcaatgattgaatcttgatgtaatttgccaagatcccagaatctaccgcagatgtttttgatatttacccactagccccactgggacaatgattgttaaaattcaaagttgcacatattctattgtaattcattggtgtaaaaggattaaaatgttcaaaatgtttcaggtggctttcaaagttatcccctgaagtgtgaactcgttaccaaggaaacacattgcaaatgttagtaaatctttcactgacttgctttttacacgtccccatggttggcgtgtatgctgagcccatttagcacagtgctgctggcagcttccattcctgttatgtttataaatacatccgagcctcacaaaaaaactaggcagaattgcttggagaaaattcttctggttttctttggagtgagagagcaaaaaatcagaggatcacattgattcgaaatggcttcgccaggttaaaaaatctggcgtgatagagttggagggaatttgggggaacaccaaacagtaaaacaaactcagcaattgtcatgacaataatatttagactaaatcataatacatcatctggattgataataatatttagactaaatcataataaatcatctggataattgcaaatttgagtggtgataattttgggaacatgtgattaacgtattagagatcagagtaaaaatttgccttgtaataataacactttctgggacaaataaaagaccattttgtatttttaaataatctttttaaccacatgaaatgtactataaaaaaattgtggttatattgtcattcagattcttttttactctcaactttccgacttcaaggcatgtgtaagtccataaattctcaatgtgagaggtgtggtgcactgcaatgcattattgtatctgttttgaaaggtaatataactccctgtaatgtggaaggacacaggcacaagacaaataagccataaatagaattgatacttatatccagtcagaatagttatatttaattttcttaagaaaatgattaaataatctaggctacagtcaccctgacaatccattgtatgtctcaatttccactataaccaacatttgataactggctatatttcattgattcatttattagacgaccacatactactgattacttactagacaagtgcttgaggtttcaaaaataaataataaatggtccttactctagggattgcagttttagtggtggcatgtatatacagcaattacagtcatgtggtattagagacatgaattagaatgtgtgtaagtcttctgttgatcttgatcctcattactaaactttaactcaccccattaatggaaagactgtaaaaactatccatcttgttgtatgaggaacagcttactcatggtttcaagcatggagtcacattcactatgactgggtaaaggtctcggtgactaaatcaggttaatactaggcgagaggctatgacttccagcatttctaagaaaggaaaatgcataccattttggcctcaagcactctgttttttgtttttgtttttgtttattcctcactagagatgactatagaaaactaacatgacttctaggtaactggactactatgaatccacccccaaggtttagaatgcttttcaatgccccgattgtgtaatttaatgtggtattgttcttcccctcacaggtgtccctctggctctactgaacatactgagcagggaccttgaacctaattaatctcctaaattttaaaacctgtgatgacctagggcaagcataaatttggaagaagcaaagacaatatatttatcttgaaatatttcaattaaacttctgacttgttgactttattgtaagagtttgtttttatttatttatttttttgagacagagtctcacttcatctcccaggctggagtgtggtggtgcaatcttggctcactgcaacctccgcctcctgggttcaagggttcaagtgattcttgtgcctcaggctcccaagtagctgggactacaggactgtgccaccacacccagctaatttttgtattttttgtagagacaaggtttcaccatgttggccaggctggtcttgagcttctgacctcaagtggtccacccgcttctgcctctcaaagtgctgggattacaggtgtgagtcactgtgcctggtctattgcaatagtttctaacttgtcagaaagagtgacacaaaaattattttattcattgaaaacccttctgattgtttcaaccatgactatcatttgatttatgtgtttgtttttcaggttttgaaaatgactgccaaaaagtttataagctgcaacattttaagtaaattttattattaatgaatacacagaaattgaaagtaaactcatggcttcaacctttataccaaacctccagtaagcaataaaaatatcataaatttattaaacaataaacatgtacttaggaaaaaacaaaggagaataatgaagaacaaagaggcacccaaattaactttttaaaaattgttacgtatttatttatgtattatatttatttaattagagacggggttttgccatgttgcccaaggtgctcttgaactccagggctcactccatccgcctgcctcagcctttctaagtgttaagattacaggcgtgagccactgtgctggccaaattaacttttaaaggttagcctagttcaaataatttcatgttccctttctttttccaaaatgtgcttttctgtattacaattctagaagattagcatggtttttagggatgccaattcctatgtttttagattattctgaaattggagggtcatattatttatattttgtattcctaaattataattttaccatgtgcctaagatgttgatttacagtatattttatttttcttcagaaagacataaaggagagatgaatcaaggaatcttatccaaatgcttttcaaaattagtttcatgcatgagataaaagtttttaatgtctaattgaaatatttatattttcactattaagtagaaattgatattaagaatgaaatttagccatatgttgaaagccagaaagtaacagtcaaagaacacacctaaattaacaaatatttgctttgtggtttaaacattgcaattaagacactattgttactttgaaggtatagattttaagtcacacgttgaaataaggcaaagaacatgacatataattgtaactaaaacgtggccatcttgacaacatattttgatattccatagattctatctcttatatatgtgataccatggtgctaaatctttatactattaatggctggttaactcaatcaaataaaccagttgttttagtattttaaggtagaggtttcttatatgctataataatggagaactaagcgagaattctctttgtctcttcatcttctttttgcatgtaaagttgtgtctacatttagcatatccaacattttggcattcagtcaactgtgtggaagagtacattgacttcaaatgaagcacagagaagtggaacaggaacttcatgttagggatctaaatgctaatgagacccttgcacatgctttcttgacttcgaaattaatatacatactcatcagtaccctgtctttctatttcttaaattagctcaagagagcagcatggtttccagcgatggttaaacatttccaccaagaagccttagtgaaattggaaagtaattggaagacaaaacaggtatctatggcatattctcttctgtaacactgaattttttttctgtttctgtttcagattttatactcattctaattttacatttttagtatgtatttctttcaaactttatagtaaaattgtctccacaggaagatattagcatttatctcacagttgctaaaccctcttactacaatttgaagatcaagaacagagactgatggagagtatagttctggcttcaacagtgactagcatcagtagcctcgaacaaaattgccttatatccttaggctccatttcattgcttgtaaataagggttttgagaaagttctgccacaaaactgtttaatgaagctgttaaagtataaggtttatattgacttgttgtattaaaaagatttaaaacacccttttatgccaaaatcttgcccccaatcattaatgaaattagcctcatggttttttttgaatgacatctacaattccgaaaccaatgagagggagccctcttgtggtttaggcatagagtggcttatgttctagctgcatttataagatacaagaatgtataatctttgaaaaatgtaacaaccttagatacctactgaatatgatctaaaatttataggaaatttaaaaattacaattttggatatgtatacttgttctttaaataattcaggggagtttttgaaactaaaagtatgcagcacatagtatgttgctgtctgtaattatattcttatttagtaaaaacctttcagtatatacttggttagtagttataatgatcagtaaagacaccaaagtggttcaggtcacctcacttaggaagtagaggacaaaataatgacattaaaatagataactgcacattaaataccttttatactctttaactgtatttctgagtgataagcatcaaacattttgatcacttagggatttaccatgcttataacagcaggtgaacttgctatattttgttgcttaagaatacaatatataacacatattaaaaggtaaaaaattaagtaaaaaatttatgaagctaaggttaattattattaaagaaatttcaaaaattaaacttactgtagcctaagtgtacagcctttaaaaactctacagtagtgtggctgggcatggtggctcatgcctgtaatcctagcatgttaggaggccaaagcagatggatcacctgaggtcaggagttcaagaccagcctgcccaatgtggtgaaatcccatctctactaaaaaatacaaaagttagctgggcatggtcgtgggcgcctgtaatctcaggtactcaggaggctgaggcaaggagaattgcttgaacccgggaggcagaggttgcagtgatctgagatcacgccactgtactctagcctgggctacaaagcgagactccatctcaaaaaaaaaaaaaaaaaaaaaaaggtcaacagtagtgtaataatatcctaggacttcatactcactcaccacttactcagggcaacttccagtctgcaggctcctttcaagttaaatgccctatataggtgtactgcattttaccttttattctatatttttattgtaccttttctatgcttacatatgtttagaaacacaaatacttaccatcgtattacagttgtctgcactattcagtatagtaacatgctgtacaggtttgtagcctagaagcaacagactatcccatatactctagcctagatgtagtggtctatcccatgtaggtatatagaaatacaccctatggtgtttacacaatgacaaatcatctaatgacacatttcttagaacatattcctgtcattaagcaactcatgacttatactagcacattaatattactttttaaagtttcttttcagaaatgaaattatattatccattaggtgaataaggcatatgaacataatttccctagttgtatatttggtgacttgaaatttcatcttttttcatttaccccagcattttcattaatgttcacagataatataaaaagatatttcaaatataaccaattcgcaacagtaaatggattctaatatatttgatttaaagtaaattgcaaataacataacatgttcatttgtttctcatattctttttcattcaagaaggaaaaaacacaaattaatcacctaagttggaaggatatttcaatccactatatgcaatgcatcaatataagttccatcactttagaaaagactgattcttgcttagagattattgattacccaggagaattactaacctaaagtgaaaataaaagaaaactcttgtctatgacacacggttcctgcagattatttcctgttttgctttgctcctgaaagtggaggaagcttttctgtttgttacccattgaagttttcatggcctaataatgtggcgactcaaaaaatttgctgatgataaagaggagaacaaaggaagcacccagcttcaattctggtatttatcaaataaaatgtgatagagtaaagcagtgtttcttagaaaggatctaataatttattatcaatcttctttaactttctggcaattaaaaataaatttgtgcttttggattttctattatctgtcaaataatttggcaattttaataaatttattgtttttgatttatatttcattccaattttctttgattagccacttaggaaattcaatgttatacctgtaagcttgatcttccacagaataagtatttcaaacaaggtcaatctgtaggaatttgctttttggggagggagaagtcatttaaataagactctataaacatacttatttctgtaacagatcatttagaagagttatttttttcccccagaaagaaaaggaacctgacatcaaaatagagattttgtaacggcttaagaacagagaccagtttggaagatcaagagccattaggttacagaactgtgagtgaatgtcacatgcattttaactagtattccttcattgtttgaagaacaagtgttcagacaattcattcctcatgtcacagaatgggctatagatgatgataggattctctcctggaccacgctctggtcatactcctctgagatccctttttgattaggccccaacttgggttctgttcttggcctagttagttcaattaggcaagaattctgctggttcagtttaacgaaaatcccttatctttgatatctaatcaaatttcttatcccccccacattcagtatcttatcaccctggctgcattcagcaagaattttgctaagtcagtttagccagaatcccttcgaggtttcctctctagtaattttccacccactgaccatcacttatccaaaatccccacttatcctggtattcagaatgcagccccgttctatactgaggtctctctgtccccagtgcaatagttcctgaataaaatttgccttcactgctttaacttatgtccagctctgcttttctttcacagtgccagcttctgttcacaacccagcttccagttaacagtttgcccaagtgaatttttaaatactgtcagagcagtacaatgttggataaagagcatcaacagagataacctgataagacaacacatggggtcaaatatacaaatataaagaaacataaaaacaaactaaatatttatagtatagttcagtaaatatggtctaattcaatttaggattccaatgaatgcgtatttaaaaatgcaaattacacaaaattacaaagaaggaatatatttagaaaatcagtttatcaaggcagaaagcaactgtcagcaagagtatattgaaataaactatgtaaagaaaaataaccaatgtagtgatatggaaaatgatgaatatcatgagagtaatgaaagtattttaaaccatagtagtataaattgacttaattaatcacagtttaccaataagcttctttccattcttagtgtggtcacattacatttattcctatacattttgtttagggatccattacctatagatatcgctaacacttgtacttacagatgacctggactgattctatggcagtatttcagtacagagtttttgctgatgtcatgatatgaaccacataagcaattagtgaaggccagcttactgaagaaaatcatcatgctgatttagcaaggaattttcaatctaagtttttttcctgaactttgtgccagtcaatatataaaagtgtcaaacactattacatataaattataggtactttaaaaatgatagactaattatcacacaccaaatagtaatattttcttaaatttcttggccgggcgtatttttggaggccaagtatttttggaggccgagggggggcggatcatgaggtcaggagatcgagaccatcctggctaacacggtgaaaccccatctctaccaaaaatacaaaaaattagccgggcatggtggcgggcacttgtagccccagctacttgggaggctgaggcaggagaattgcttgaacccgggaagcggaggttgcagtgagctgagatcgcactactacactccagcctgggtgacagagcgagactccgtctcaaaaaaaaaaacaattcctatttgtttactactattctatcactaaactccagtctaactctgtggaggaaaaaagaaagatgaaattataggtttaaaaaaacatcagtattccattttgaaatagtctctatgggtaagtcaagtgaaagtggtttattcaataaacagattttaagaagtctttcaaacaaacaaaaactacaaatacactaatgccaaatcatttttctagttagtaatacttcttctctcattctatccttagtagaaaagttccattcaccatccttctcattgtgcttttcctataatgaaatgcatatattaagacttctctgaatgatatatcactgactttgtaatcctagatgtaatagtttccatgagaacaggaatgtagcatgacttttgtcaggaagacaacatgattctttggtaaaatctggtctttaaaaaaattagacaaaagaggtatccatattcttgaaaagtgttcatttttattgtttcggatcaaattatctatagttacatgttaaatactttatactgttcacaggttaatgactctgatagagagtctgttagttgcaaaattgaactaaatataatataatgaaaaacaagttgatgaaatcgtgcataaatttttaaatatgttttcagtataatttcctggaaaaatatgacagcatctggacaaggaagacagacttagacataagactcaagaagacagaaaaataatttacaccataaaaaccataaaatagcaatacttcttttggtagtcctttaaacaacttgactcactaataatgaagtcactgtatatcatataaagatggtacatggaaaatatatggcacattttctttttgttttgtttttcatagcatatcatattatatctgtagaatgtcagggtacttcactctatttccccccccatattatcatttatcatacattaaaatacaaatttaagtaatgaccattgaataattcatagagaaaaaagtgaagaagtgcaaaattattcaagcatattcaagtacaattttacatctgaatcctttcctgccatttaagtcacagctccctagtattaaccacccaggctggatactgtgtatgtgagcggggttgcccaaaggcgccattgctaaaaccaccccagagtaaaagcagctattaaaataaaacaacttaatcccctgtacttttgttatagctttactctaaaaacacacaatatggttaatatggtttgctgctagtttttttaaattcatattactttgtagagttttatataatatcttcatatctgaaataaatttaaaaatatttaatttaaatttattgctgttataggaagacattaacagttactgaaaataatatacatagaaattttcatcaatttctatttatctatgtagataattaattttatatttcattattttataagcctgaaaatatctcatcattgtttaacacttacaatgctctcatgaatggtttaaataagaataaagctagtgataaggggttgattgaacttaaacacagacagcagaaatgtgaaaatatatgctagttgtcttataggaggggaataaacttacttggtattttaggaagtaaaagtcatttcttgatgaagattaacatttttatcatctagagttatgtcacaatggaacagaagactgccctcagagtaatgagctacctgttgctatctgggtgctcgaagaatgtggataatgtaatggtgaagattctgacattgggaggaaagctgaattgaaacgcatcaaagatttattttaaattctttttttgtctgtctgtttgtttgtgagacagagtctcactctgtcacccagtttggagtgcagtggtgcgatcttggctcactgcaacctccatctcctgggctcaagccattcttccacctcagcctcccttgagtaactgggattacaggcacctgccatcatgcctggctaatttttgtatttttagtagagacagggttttatcatattggccaggctggtgtcttaactcctgacctcaagtgatttgactgcctcggcctcccaaagtgctgggattacaggcgtgagccacctggccgggcctatttttaattctaagaatataaatgagagacaactaaaattagttgcttgaagaaagaaaaaatgataaaacttaaaaagtgttaaattgatccttattaagagaataagcttgtgtaagttcacacgaattctctcacttctggaattttttcaatcatccagaatttcagatcttattccaaaaatactaaatttagcacttgggacagtgccaggcacacataaggtactcaatgaatatttgtttaatcaatgattaaatcataatcttctatgttggacaccaagcatatgtatgtatttttaaaatgtgtaaggaattccaacacatagccagggttcaaaatcactttttaaaaataatactccatcaccttaaatgtctcctctttgtttatgtgttaaccacaaaaactactgagaaaaccacctgttcagacactacaaagtcatccaatattactagctgtcttttgaaaaaggtttttgacagttatttagctgttcttcaaaaacggttcaaatagtgttttagaattcgattgttaagggttaaagacttgatccagttagctttgtttatgtgtttttgaggcaaaagattgttgcatgattaagagctggccaaatcgaatgactgcatggttcatattttccaccaggaatcacttaatattgcaaaacatatcacaggattatgaacctttgtctagaaaaattgactgtctttgtatttttaatctaaaggaattcatctcattaccaatatgtgtatgtgtgtgtgtgtgtgtgtgtgtgtgtgtgtgtgtgtgaaagagagagagagagagggaaagggaagagatgaaggcattattaagatgtaaaatgtagaccaaaaaaacaggtaagtgggtcctagctactaacttgggattatatctcttgtcctcatatctggaagaagcttccccaggatatttttccctgccctagttccgtttaaattgtagagagttatattttacacatggcctataagtatctttgttatggaagaatatgcatcactttacttttgaagtaattggagtaccaggtgtctccctatggaagttcactttttaatatcactatgtttgtaaagaggaatgggggctgagataaaagtttaattttaaagttaattaaattaatgcaatttacagtgtacactgcttatttatccatgaaaggtttatataacaataaaaaaaatgcagtgaggctatatttaccactgtagcacacaaataaggaaataaaaaccaatgcatctgctgaggaagatgtctcttatacaggtacaagatgcaatgggtattatgggtactttatttgcaagagggaatctgtgtgaacatttacactatttcttctaatatattgtattaacaccagattgtcttatatttggaatggcttgcttttctttgctagttcaatattaactagatgaaaaatataggtcgtatatgctgataaattttgggagtttatgctattatctatgttgcaaagagtgtggaatcacttttggagtagaagatatcatgacctcaaggattgttaatgatatctgtctaaggatcattagatacatttttgttctcagagttttgttcttagagtgttctaaatttttaggggacacctgtgaaaaacaatgctgtcagtttccttcttttccatttacaaaatactgcaagtattttccatttcaattttggcaagtctcttgtattctctcatgtccatttcctggaatgtgtactttatagatgaaataaaaatttagctgccagtataatattcagtcctcccaagtaaccagcaggttgaagtatgttgtgttgagaaaaatagaaaagcatattttaaaaagtggaataaaaaatgttcagaaaaagggatgtatagtatggaagatacatctaaatcttttttcaaatattataactacttaagttgcactgagtactaaagtagtgaacagcttgctctcttctgttagttaaacatttagattattcatttttttttctaaaatttcccttaccttccatgagatcctgggtattcataaactaatacatgaattcatgtcttagggatatataaatatacaagcaattaaattccaaattaagataaaagttattagaatatatcaacagaataagaattaattttagaataagatgagcagtccggatgattccctaatatagccactgagagttggatggggtctccagcgccatggagaaacttttggaagggttggagaagttttaaacaccctcagctttcttgaaaatacagtgactcttgaatctatttaaagttgtaaagtaagttctagagcctcattatggtttaagttcaattctaatggttgggaaagaaagaaaaggttgggcacatatatgctaatgtataagatagcctataaattcatatgctatggaatcaaatatttcaatgattgacatacaaataattctttttaagaaaatgatataaactgcatacatgaaaatcccatattttctaatgtggctattttaaaatacttcagaatatgcacattggaattccaatttgtgtgtttagtagttaatgtatatgcacacatttttaatttcttgccattaataattttgtggttggtttaatttaaaatattctggttggacacagggcttattgaggcaaatattatctcaggatgctaactgcaatgtaatttttcagttttaaaaggtctataagagttcgaaggaggagacacattcctttaaacatattggattcagccacatgcaccttgtcactgttgccttgtgagtgaaagctgttaaagtattttcttagtgcagtaagacagtgacaaatataataggaaaggaaaactatgcctaaggaaagtgtaatacttttgagatagatttctaatgtaccaacgtccttgttgacaatattgtctcatgtttggtattttcactttctaagtttctgatttaacaaagacacatttataatattctcaaatatggaaagaagtgatgtctgtgaatttcttttggaagtaagcatgtttgcattcattatatttctgtttgctcctggcagaattcacttaagcaatgttgggaaacttttgaaataagatgtggaaagtatagaaaaacgtattcaggtatttcagagacacatcgagatgatgtagtttataattacctcaaactctcctgctaattctcaaggaatacaaatgacatatcttgctctaatctttagaacaagaatatgtttccatggttttgttaaatacacaccaaatgaagaagcatatgtttaattttcaggtgcacagtcctcaacgtgggtacttacagagtaacaaattcttttggttgtgtcatttgcacataatgccaaacatgatattatttccttatagtgttgttttaagttacttataaaggaggggaacttggtcttttactagcaaaaactgcttaacatttactattttttaaaatgttattttaaaaaattacaattgtataagctgatgtacaataacattgtaaaggttttagttttaaatggtagtttttgcttttaatttgaaagtggttgaagggtagaaaatagcatcttgttaaagaactggcttttctattgtacatctgagttcattgttttcttaatctttaaagttttctctgtgaataatttggtggactgagtttgtgcatctgaccaataattaaaatacctaaaaagcattccaaagcttttccaaataaatttatggtaaaaatagttaaaaaaatagcaaaactgaaaaagagtcagagtctggttctgtttaccaagaactctatcatacatttgcacccaattacactgcaaaaaacaagttactaatgctctgtttttgttgaagtaatcccatggggtcattgaaaaattttatgtaaaaatttcatttaaaattattcacatcttgcgaatggcttagattttgaaatcattaattcagaaatagaaaaagagtcctcactttatagaaatgacttacttatatcatttaaaattaaaactttccctacttatatttggagataggagttgagacccataaaacattgatgggaaaatggtttttattaaaaaatcttccatgaatccattttgttttcattgtattcatttttatcaaaatgtaaatactttaatcccattgaattttaaagtcacattctaaactaaaatataaaagtcttactgaattttgtcctgttatatcaaattattaaacacaatcacatacagttaagtagctattaaaagtctaacaaaaacaagggtgctggcttgaattgttcaatgtttggcaataactaaaaatacatagctataatacttatttaaaaacaaagttgtttcccgtatttccaccttcgttcctagagatacaaagtttaagaaaagtagattgtgactgtaacacgatctcttgttatttgttttaaatttgcacagaggaaaacttaatattctaaacaattaaatttagtattccaaatcattaaagtcttttaatgctcttatttaaaaattttcaaaattacatatgttgtttaaatagtatttatatgtacaatcctccattaatatgagtgaatttcccactgtaactaattattttcccattttgtaactatactataagaaaatagttttaaatctcaaactattggtttactgtgcaaaatttgcttttgtatgatttaatagcattgaattacaaatcaaggaatttcaaagtagttttcatgtctactattatgagatattatataacatataaacacattggcagtaaagcttccacttacatggtttactgtgaaaaaacaaatcacctggaattaatatgaaatagaatcccctaataaatattttatattcattaaaagaatctcatctttctcatgactttgcatagctaaccaaaatacaaagcttttccatatgccattttaatacaatggtcatcatttgtataccacacgcacacatatacacatacacacctatggcagagacactttcttctgaattgaccatttgcatttgcatgcccccagagacttaatcttgctgctgatgaatatcctcatgcctaagaattttatagataacccagtagaaaatattaaaaatcaaaaaagctaatgggaagcaggctcgggagatggtatcaatcttcttggcccggtcgataaagaccttcctcatttcatcaggactttttggcattacctggacagggtggttggggccctttggagtcatgccatcctttgcttgtagacatggtcccattccataggctgtgaagctgaatcggctttcccttacctcatcatcctgtcaaagaaaaatgtgacaaggccctttaataatacaatagagcatgtataacaggcatctcagaatcataaccaattttatcatggttaatatttacattaatataaggaaaagataaccgaagcatataaagatgaattggtttttattccctattgaagttttattaatttatcttgctgcattgtatagctgtgcccattaataaatgtgaaatcccaaagggtatgttttaatgggaaaactaaattctgatattttctacatattgcttgaatatctaaattaaaaaaaaaacaagataaaatctattgtgttatatatgttcataaactagatttttttttttgcatttttttttaaatggataaatgtgtgatgtcgaaggggaacataccaggatcattgactgaatttttctttctcatggagacaaaccttttaaagtttttctttcaattcgaagtcaattcctcagaaaatacagtctagttcaataatactgtttggtttatgttattctccctttatgctacttttctgttttacactaacctttttggaatacttagaagatggccatgtattctagtttatatatgactatgttccaggcacattggtttggttgaaattgtgaattatatctggcagaagtttatttcatgttaagaacataaacttttcataaatttattactatgttcttctaaaaagtatcatttcttttaaatgtggcaaactgaagagaattttccatgtttgtaaatgaagggaataaagaaaaatttaaataaaaaattatttaataatatatgatgaaatatacttgagagaaatataatatttaataacaatgcaaattattaataatttactttaacacatttatttagagtgtaatggtagctggctaccaatgagtaatggtttatttggctactaaattgaaggtctaaaagatgagaagacatttaataaagttgttatatctctcctatgataatgctttttcataataatataaaagatcaaataattggcttgaactcttgaaaattatgggctgggcatagtggctcatgcctgtaaccccagcactttgggaggctgaggcaggtggatcacaaggtcaggagatcgagaccatcttggacagtatgctgaaacaccatctctactaaaaatacaaaaattagctgggtgtggtggcacacgcctgtagtcccagctactcgggaggctgaggcaggagaatcgcttgatccctggaggtggagattgtagtgagctgagatcgcaccactgcactccagccctccagcctgagcgacagagtgagactccgtctccaaaaaaaaaaaaaaaaaagaaaatgatgttggttctgtgaaagtagctcctcaatgaataatatattataaaatatgaaagtgaaaaaatagaaattattatggattctaaaaatgagaagatgaccaaaattgatgcagtaaggtataaaatagttattttgggaattatgaaagtaacgtgattccacctgcaaaacaaaagtatatgattattggaaaatatttcaactgtaagatgtataagccattgaattttgaggacacaagtttgaaagaaaaactgacagtccaaactacctgagactactgttgtaagctcgcaaaaattgaaaatcgattttccactactctttaacaagcatgttcatttagactaccatttctttggcgtccatgaaatttttaaggcaaatttattatttgccttaaagttttccatatcctacaaattagaattaaattgttcttatgtaaatgctaaaatagcatccttataacttagaaaatcatgctggtgtttgcatttctaaaggaaaatgtaggttacccaggtaatttgcactattttgtgtaaaaatcacctgaatgttgaagtataaaataggcttttaaactatagcaacctatgtgttaaaagacatctatctcaaagtaagacaaaatatgacttctcagtgagcatttccaatgaggtgttgacatgttaattgaagcagttgagaaattcattatcaaaatgctcagatatcaggattctagctgatgtgcttagtaaagcagaattcattgactacctttctaatgatctgttctgaataacttattttaaaatctttagagaccttagctgctcatctcaaaacaaacataatctatttaaaattaacatattagtgagcaaccgaatttttctcaattgtatctttccatatagctgagggtgagtaaagagttaatacccagcctgggctgttacagtagtgctgagaatgacccctgattcctaaagcatcatttccttgaaaacaatggagataagctacagggggaattggagtcggccttttttactgtgaggggctgcacctgcactgggggagctgtgtattggcctgaagacctttggcccatgtgactagatggtatgcaagtgtggtttggaacaaaggctgtgattccctgtgtgaaggcaatcataaacaccctgacttttgtccatggcagctgtacctatgtgtcctgtgtgatgaggggcaaaggaagctcttgagaacctgctgagtctcctgtgtgaggcagatgctggaggtctgatgggtttcctgcctcacatcctcctagggggctgagtgaacataaggttagattaaagcctatgggtgttctgagagtctgtatgacaattggaacctcaaatctcagcagtggtggacagaagctgaccaggctttcagatcctttgagactcaatatggccaaatgttccaggagggagttctgaggagaatctgatgctgatccaatccggttttgaggtagccaaagtgctacagaaaataacatgctgaatcttattattggaacatggatcgcacaggtttatcccctgttgaattggcagatggatgatctgtgagataaaattgagaggaaagtggctcaagagacagttaattccttgtttcctattaataatttcgggggctgggggcggaggctcacgcccataatcgcagaactttgggaggccaaggcaggtggattgcttgagcgcaggagttggggaccagcctggccaacatggtgaaaccccatctctaccaaaattatgaaaaattagccaggtgtggtggtgggcgcctgtgggcccagctactctggaggctgaggtgggaggattgcttgaaccgggaagcagaggctgcagtaagctaagatcgcgccactgcactccaacctgggtgacagagtgagagatcccatctcaagaaaaaaaaaaaaaactcatggaaaaaactactcaagggaaagagacacagccagtaaagcaagcagcttcatgacctgagctcaagatgaaaacaaaagcccagttggtacttggaaggacactgcccttaattttaatcttcccttctgcaactccaggcaagtgacactgcaaactagtgactatagtgcagccctgttccataaaaacataatgtgagccacaaataaaagccatgtgtgtgattttaatttttacattaactacatttaacaagttaaaggcaacaggtcaaaataacttcagtttgaaaaaaaaaataactcagtatgttcccaatatcttttcaacacttattgaaggaaaaattgagatagttttcattctttatttcatacaaagtccttgaaacctggcatgtgttttacattcacagcacatctcaattcagactctaaatttctagtgctcaataaccacatgaggctagtagctaccaaattggacaaagcataaagaagctgggtcactttgctaagaagtggtagcagttctctagggaatccatgctttcctacatctttaatttaattgactaaggagctgataacatatttttggatgcagtagtgtgaaaagtaatgtttggtgtgaatgctaacccccaatctgctgcagtgttaccattcaggaattactggcaggtgtaatgtcaatgactcttttggagtaggtgaagcctggggtggtataaatctatgttgaggactgagtgtggcagcttacgcctctaatcctagcactttgagaggccaaggcaggcagatcacctgaggtcaggaattcgagaccagcctggccaagatggcgaaaccctgtctctactaaaaatacaaaaaaaattagccaggcgtggtggtacatgcctataatcccagctactcgagaggctgaagcaggagaatcacttgaacccaggacgtagaggttgcagtgagccaagatcatgccattgcactccagcctggatgacaagagtgaaaactccatctcagaatcaatcaatcaatcaatcaatctctgctgagaaggactgactgatgctctcactgctgtgaaatgtaacacctctacagaagagtagatatgttaagtatagcagcaaatctggggtggccatatgacaatgagaaagaagcctacccaaaccatatcccccaaccaaaacttgggtaagcactgggttaggagagtccttaggcatgtggccctcattctgggaaggcaggagggtgttttgattcatgggtatattaactcttggagctactacactgggttttactgatgagaagaaaatctaggctgttcagaagaaagatcatggccagaggtacatctataagctctctttaggtggctgttaagacacaaaaagaacacagcaaaaattgacaggatttctgtgaactatttcccagcagattattgcctgctgggaggacggaaatctgttccaattttggcagcggactccactaaggaaccctgttcgatctgttcttttcagctcagaagttaaatcccacggtgccaatggggaatggaaacaaaaggcactgacataggttgctaaatttactccatcagttaaggcagctgaaagaaacagactgactcgaaggccaggatttccatgcccaattcttaatggggctctatggctgtgctatggttaaagatgaattgtcatgggggtagtgaacacagcttcttgcaattacctgatgccaaagcaaaatatgtggtaatatgctggggaacaggaaagcaatataaagagtcaaacagaagctgcttgagcagggaaggaggcaaaggatcagctatagtagcaggtatcatggtcacactaaaaactgtaggtaggaaaaaagagagtaagatatactcagtaggtggcactgcctttaaccaaatgtatgattggaaaggatgtgatacataaatgaaggatcttggcatctctggcttgagcctagtcctgggcaagtcattccttagcccagttttaattggatgtaataaaatgggagcccttagaattgcctaactcgtcctttttaggaagattacaggaactctcagctctgattaagggaatggcgcaggggtggtagttttcattaattctctctagaatagcctgtctggcctacgataaagctagatggatcctacaggctgactgctgactatttgggttcagtaaagaagtttcccaacagcctccaccatgctggctggatgtggtgaaaactattcaagagttttggacgcaaaactctatccaagagttcaggacagagatggctggttggatttgatagacttgactgatgctttgtttttagtctcattggtaaaaaaaaaagtcaaacacagcatgtcttcatgtgaggtggacacaattataatcttactgtccatccctaaaggagcctaaattctccagtatgttgtcacaaccggataagaaacaatttggtccagatcattgtcaaaagtaagttttttaataagtgatactttccctgaccaagcagaaagtcagggaagagtttggaaactagtggcacctgtgactaggtacgggtggctaattaatccagataaggtgcaaggtccagccccatgagtccacttacaaggcataaccttgtctgaggacattagctacaagtcacaaacattaagggacaaactgctatttcttctgctttctattattaaaaaaaagagaaaaaacttgtggcactgttaaaatttggcaggtacattttggatttctgttggccccactgtataaagtaaccagactgaatttcaaagggaaactaaagcagactgtgagagatctaaagcacgcagtagccaagctggtccctctgaggtcttaacattcactgattgtgcaagtatctgctgctaaaacacacatagactggagtttctggaaaaagctcaatagtggcactctaaggtggctgctaggattctagactagaaaatcctctgacactgtcagcaggtataagctacatgaatgacagctactgacattctcttgagttctgattagaaacagccgcccagaccaaaggaatctgaaaggcatcagtccatatctaggcctgaaatacctaccccatcatgggtgatgtcaaaaaggcattccagtctaagtgccctggcaaaattaaaatagtgtattcaagaccaactcaagggaagtgactctgctgaagtgtatcatgtccatgtaaaaaaattctgtgtgacaatgggccaatgatggaccctgcagctgagtacccagaatggtctgaacctcatgactctctttcaacagaggcaaaacagaccatctagtttaccagtggaaagtcccatatgtggtgagagcttgtcctgagtatcaacaagagaaaacttgtatgaaaattgcttttggcttgaatcttccatggacaagtgctaacacatagctgtagatgaaatacctagggttcttgcccttggcttctggaggattcagtggcttttgcctgaaattgacagatattccatcttgggttttgtttacgttgtaacaaaagccatagctgaatatactattaagggcttggaacaaggcatctttatattagcttgggcttctcagatagatctcactgaacaaaggaacacattttagcccaaaatgcacaacatggcccaagggcacagcataggaagagtacctcatatcccatctgcccagagagcaaaggcttaaacggatattggaatggccaattaaaacatttaattattaaagatgagatgacaaggacatggaaagtctgcatagccttaatttagctacttaactttatgattattggtttcttattccaggaaaatatttattatactacctatcagttcttttagggtgagagaaaatatataaaccaccggacaaagcactcaaattgctgctattatattattcatattttgagtgtaatattacattattctagaaattgcacaaagcacaataggaaagaatacaaataacaacttgaatcattttactattagatgttttaaactcagagtaaccaaactagcactaaaatactatgtaaaataggcctacccagtcacctgttctccaggtggccttgcatttgagcactattacactaaaaggttaaccaacagcataaaagtaaaaacatcattcacccctcaagtcctcactgtcttattattacaatacatgggttttgccatgtgactgctagaattccttgcaaatctaatttatggaaccaaagagtctttgtgttttaaatgtgttccatgaaagagtgcagatcattttgaatgtgcccatgagatgaggcatgtggagtcatatcagacccctttcagaaacaggatctcaactctgtgggaaggaaaggaacagactcctgtacagggtcctgtctgctctcgcagtaagacaggggatgagagagaccatgagcccctggaccttaaaaacatcaagttttttttttaatgacctaaacaataattttaagcatggatgaagcttttctatcagcttattattattattagattactaaattagaagaagcactgaaatattttattactaatttttctgctttgcattacccagtcataaattatcctgtgtttatgtatgcttacgtgtgcagtgatattccttattataattagcactcaaattttttttgagataatttaattttctggaaatagcttcagcttacattctcatggattacatgtcaaaaaagcaaggaataaaaaataagtctagaacttttgactcagagacattatgtgttagccaatatttagtggttataaaattaaggcccttgacaacataaaatatagaaagtgggcaaaatcgctgattaaaaagttaaagaagtagtttagtttacccacaagtaaaccttcttactatgtttcaagcaagttagaatggtaggcaacgaagaatggagataaccatttagctactgcacaattctttttacaggagtatcttttttctgtaaatttaaaactgacaaaaaaaaatttcagtcattatgcttctatatcatactgtgagactttgtatgtctcttttcattttatttcaattattatgccaagcactgattcatataaaatgcaagttatagctagaaatattagagacagacagaaaatagaagggtgcatacagtcattgaataaaattgcttcatctctgtcaccaaacatgatactgtatattaacacatgtgtgaggcaaggactaattttgtatcttcttcttagtcctcaaaattgaccagaaaaaagaaaacttatgtggatgtgagagtgatgaaggcatgaatattgctattgagtgtgaacaaaacattaagcatctagaacagcatgaagtattgattatgtgaattgctgtaagatataacagcattaaacacattatttgcatcttaaagtttctcccttagtaggtacctttggggcaatgcttatacaattaaagtattaaatagattattccaaatgtctttttgccaaatacttttttgtaactttattaccaaataggaatgtaaaaaacaaaggaaaattaaattgttattaatctctatttatatggtttcaaaatgtgtagattattttaaattgctaataaacagcaatgacttattttgttgggaaaaatcattgtcctttgagaatatgaagaacagatgaaaaatgtgaatgaattaaaattgtttttctaaaatatctgtctaaaataaaatattcagtttcatatatctacacacatttttatatcatttataaatggaaggtctaaaataatgcaattatagatgaggtttaaaaaatactttgctgttgtaagtcaatcgttaatataaaattatttgaaagttcactccaagagaaccctgcatttattatagatgacatctgaattagctattaattagccaagtatacacttggcatattaaacttagattcagaaatagtttggacattgataaatggtaaaatttaaatttaaaaagatgaatgttttagatgaaatattatagaggacggataagaaatcaatggaatgatttatttaaaaatctatatatctatatctagcataatatgttagattcacttactgccaacttataattacggagtgacatagggtattacaatagacatcatatgttaaaaagcagcatttctattttaattaacattgagatggaagtcactaaaatgcatgtaaatttgaacagagattatattattttattaagtattattttcctgaacagattttcagagaatatagctataagaaatagctgcgtttaacataaactaaatatctaaatatttgtttacagggaataactgaagtcttgcaatttttgtcttatttgagaggatgcgatttcaactcctgatagtagagtcattcaaacagaattttgtttgaatctaagttattgggaaataagttttcttcgggtatgcatgaaagacatttgtaggaaacactttatctatttaaagaacatcttagctctagaatagcataagctgacctggaatggaaagattattgaataattagtgtatatggatgccatatggctttcaaccgtgaatccttctcacgttcatcagaatagtatatacgtacgtttgtgtttatccttagactatagacttgacaaatgcacagggcagaaaatcaattatttattatccttagaagctatcatgaattatttttaaagtaagacagcatataaaaacataagcaaataaaataaagtttgtgtacagatggtcaaaatgcagtcaatgatatctttattttttcaaaagataaccattgtgcctagcaaaacataaacttggctaggatttcttaaatctagaactaatgatccattcctatttcatttgcatatataaataataattaataaataatcatcagtagggaaacaggcactagaatactgtgtgcctatgttttcttgcagcaaaccattgcactattacattgcattgtggaggaagctacatgaaatgcattaaagcaatctcatttcattcatatctctcaacaaataacatgttcggaaataccttggcatgtctttttaagcctccaggactaaagtaatgatatcatacatgggaatagcgactctaaccaaaatgcttccatatcatgcatacagacacacacaagcacacacacacagcactggagatagcatccatgacatggtgcagtgcgtaatcagcacacagcaggctgggacagtgtggggtggggaaatttggatacaagagcaaacttgtgttctttcacaatagatgcaggattctctggtaccttcacagagggaaaagtaagtttaaaaaagcggtatacaataactaagccaatgctgagcctagttaaaactttcctaggaataataattgcattaatgtaaggtcccctgttgtgacaaactttctacagtgagactattttatttactttgcctgttctgccaaattagagtactgaagaaaattcatgtaaaccagtactcatgacaataaagggcatagtaccaacattgagactcattttgattctatttatttcaaaatttagattactcagactgtttctaagcaaaatacatagttttaaatgacaaatttgatcagcccagagcattgttagtttagggaaatagttttcaacaagtcaaagaaaacaaccacccccaaatttgcccaatgcttgaaatattttaaaaacaaatgggatgtataaactttcttatgaatatatctgtgttatattattgtttcttctataaaaataagaatgtattgacttcccataagataagcctgttttttcattagagttttcataaagtaatatttaattaaataggtacctttcactctatagtttctataaacattaactgtttagctactggagatataattatgttggtctcccagagaaagattagagagtctgctgtatagtctaatacctacttgtatctataaatatatattgcaaacactatatctaattatgtaatttccatgcaatgaaaaatttacagttaagataatcaaataaaagcaagtggatcatgtgaaattatctttcagggatgaaaaacaaagggagaaatggatgctgggaaataagatgtaaactttagttgcaaaggacaatcgctgagtgattatatattataagagaacgtagcaagtactttaaaataataccaggtctagacaatctgttatgaggttgagattactgcaagaattatttaacattaagtctcttgcagagatgcttacctgcagtgtacaatagaatcatctggagaactacttataaatatagtttaccccagaaattaagtttagtagacagaactatttgtgtgtgacttctcaggctaaattcttggcttcagtagatttctgtttaattattgcatactatattatgaacccccaagttaaaccacgtacagacccaaactatctattttagattgctttcctaatatttagtcattatacttggacatgtgtctttgtgacctctttttatttgataatttcaaaggatgctgctatcaaaactaaattgttcacttgctataagtaacctcaacatattttaacatttagaatggattctaaagatacacagaaggcacgaagcattttgttgccttattttgaggtctcttgtgcagttgcttttagaatttgtttgtataaataaattttccatttattttcaactaattttatgcaagcatctgagtgtttcttctctggtgattattacaagatatatgtgatatttctctttaacatatatttttaaatcattttgaccaatcaaatagctctgttaataaaatgaagggtaatatttaaatatccttttattgatgagagaagacaagaataaagtttttagaaaaagaaaatacccttcttagctgaagggggatgatatttgctcagctttcaatacaaaaggggctgtgtttccccaccaaacactgccttggtagtgcagaatatgctgtctgctttttactgatgaccacattcctctatttagagttaagaaagtcaatttaccatatctgagaaacggtaaaacttctccagtgcaaaagcttctgtctgtgggaaggtaaagtggaccaagaggaattgagaaaccagagaatcaattcatatatgattaaatataattacacaattggttgtaattgtatataccatttgaacagacatatgtagcaattaatagattttcacatatgcaaagtatctaccccaacatacaaaactgaacttaaaaaaccttttttcttcattaaatcataattatgtttaattacatttgctccctgaatatatcaagtagttatcagaaaataataagatatgattgtttttgcatttctgcattttcccagggtaccaatcactggagaaaatgaatgtttccctctttctatgagctaaagaggaaggagcatcaaatattttaatttcacttttacatgtggtaaaactgaataaagaggcactttggtaaaaataattttttaaaagaaggaaccagaattgagcatctaaacttgttgtctaatactttttctactggatattatgattactggatgtgtggtggatgtaggatatgtctgagctttcacagtttacccatttggacaccggatgcacaatacttctcttttctagaatttacaggacatgcttgatacattctaaattgtataaggagaaggaaaaaggtaaagaaatggaaaaccaaaatgacaaaaagcaaatcataatgatagggaacatgcgtattgctttacttctaattaatgatactagaagggaaagtggtctttatcagttactagtaacgaagaaagaccagagtgtcatccctgtgatacagcatttgtactgtcgttgttcaaccggtgccagttatcatgaaagaaaagatgagaaagtaggcggtggagagggagagagaagaggaagaaaaagagataaaggcagaatgaggagaaatgagaaatgtaacagaccagtagaccagggtgaggtgagggaagaagataaagttaatctccccatcacaatatgtttcagtgtacaaaagatatgcgtctgttttcataaaaatttaattaaatgcaagtcttagcctgttttttgttcatgtattactaaatctcccgatgctgaatgctgatgttctttccacgtagctgttaattgtgtgtttattggagcagtgatgcttttgggaaggccaattagaaatgataagtaaagttactgctttagaatatgtttaatactaagtagattcaagcactgagaggtcaaagcttagtgctttttaaagaagtttaatcaatacataaattgcagtataatttataaagaaaccttaaaaaattgaaacctttaaatacttaaaaatgcacactatgtgaactagactgttaccattaaggtttatcttttgacaaatatgccaggatattggatccttgccacaattacacaaaattttgacattattgtccattgctttaaaagaccatttgcttttaaaatgtctgttggcacattcacattagaagtaaatgcgtggatctgcggttgatagaggctctctcttatagaaaaagaaaggggattggtcaaaaccacatgcatgtcaaggaagatgccattacagttctgcatagaggaagaacttcatttagggcatccaaatccaattaggggtttacttctgcaacttcctacggtgtcttcatgatgttctaagtttcctcctggtttcatcacttatcagatagtagccaggcaacaaaagcactttattgtgtttcccacagggtttcaaaagaaatgtctttagctcatgacaatatgcatcaagaagagaccacagagatttgcatgtatttatcatcatggtattagtaaataagtaatatttgatggaaataatgaaatgaattagctctgacaaaggaacatgaataattacatttgatgacttatatcaagtgaaactattagaaatgctctaacattgcaagtaagaaatgacataattcattaattaaaatttaaaaagtgttgttccaggaagcgcattaaaaagaacttgatataggtcccatgtcatcggatatgctgtttaaagtagagctaggtgtcatcattttctccctaaagctatttttgacacttttagtttggattggaaaaaaatgaaaggaatattatatcatttcatccccagtcccaattgcttctcttttcatctctattaaatacaacaaattcactttcgagtgaaaactggattctgccaaacccaatacgtttaatcacttaccttattctttctctttcgtcgaaatctcagaagttctttgtgttgtcttgatacaaaatttacagctgcatactccagaagtgctgaaaacacaaaaaggaggcatactgccatccaaatatcaatagctttgacatatgaaacctagccaagagagaaagagaaagcaagcaaattcacttatattgttacttcctttgagaacaaaactgagtttttctgattctgaattatgtcatttatacataagttttaaaaaataaagaaaatgacaattttttcttgaagtttccttagttatttttgtaaattttatgtattatgagcattttgttaatttttttcaaatttaggcaatagcccaaacacgatgaaagaaaacataagatgaaatataattttaccttcagaacagtatactgcttgaaaagtatgaacattgaaatatagataatgctgttggctttttagttccatattttcatcaatttttttaaaaaaattaaaattgtatttattaattctgttaagatatttttctttcattgcatttataaataatatatggttatttgctatctattttgaaatattttttgacttttataaagacatgttataagaatagtgcaaagaggtcaggctcagtggctcacgcctgtaatcctagaactttggtatgccaaggcgggtggatcacctgaggtcaagagttcgagaccagcctagccaacattgtgaaactccatctgttttaaaaatacaaaaattagccgggtgtggtggcgggcgcctataatcccagctacttgggaggctgaggcaggagaatcgcttgaacccagggggcagaggttgcagtgagccgagatcacgccacttcactccagccagggcaaaagagtagaattctgtctcaaaaaaaaaaaaaatagtaataaggactatcagcttcttcagtcgttaatatttaactacatttattgttgtgtgtgtatgtgtgtgtatatatatatacacatatatatattccctcaaactatttgagtgtaatttgtagacacaacaccatacactcaacaaaatcaaaaatttgacatttataacattgataaaatcctaccacctaatccttaaatccctcccatttcaccaattgtctcaagaatgccctttttaatttaaaaaacagactttttttgttatttgttttccagcccaggatttaatccatgatcatgtgctgcattttgttgccatatctctttagttttcagtgtgggacattatctgtctctccttgcttttttgtggcattgttacttttgatgagtacaggccagttattttctaaagtttgcctgatatttcctcatttacattcagatgatggatttttagtaggaattcccaaccagtgattccctgttctccacagtgcatcatatcaggaggcacacaatgttgatcaattgatgaaggtaatgtctgctaggttgctctattataaaattgctaatcttcccatgcatggaatattttgaagctatataagtattctgttactctttaaatcttcacacactagttttaacattcgttgatgatttttgcctgaagcaattattacaatgatggttactcagtggtgattttctaatttctttattcatctatatttatcaattagcattctactgtaagaaaaattcctgtcttctacatttatctgtttattcatttgtttatttatatgtgtataaacttatggataactgttttcttccaagtgatgtaatacattaacatcattatttattttgatgctcacattattctggattgggccattagaagcccctagatgttagcacatatatccgtttgacaagtcgccctcattatttgagcatttcctcactttctggcacaagatactccagattcatcttgtacttttcctgttcttgtttttgagtcagccctttctctcaggaactcttctgtagtgaagagtggtttttagaaaccaagatctgggcactgggtgtattcacatctccctaagtggtatcgtttctaggctctcatagtggacagagctagcaatcacacacacacacacatattcacacacacacataaaatgtagcacctgtgtaaatttctgtatcatctctatctatccatctatccatcaaacatgagcttacattacatctctatatctaactcaacaccacagggttccctttagcctataccctttctatatatgcaaaatttttctctaaaagtggaaaacttgactcccattatcctcaacatgtacttgatcattcaccgtgtatgtgactaacatctcaattctgccaaccatattttcagcctcagcaccttaatataatggtagaaccagatactgtgatcattcacctcatttttggttcttatgaaggtgctttttgtgtgcagattgttgttgcatttggccttcctgttgggaggattatggctggaggcttctatttggccaccattggccccatttggctccttgctcctggtcccatcccccaatggccccactggccttggtcctaactaactatttatcctgctccataggatctggcaatctggcagcatccttgactctggttccaccagacccagccagcctccttgattctgacacctgctcagctatggccctacaggtctcactgtgtcttgtcacctcaaaggtagaaaagggaagggaagaacaagaaaaagaatggaaaaaacagacaactttaaaaatgaacacaaagggaagagacaggaagagaagagtaaaaagaaaagctacgtccgtattttctagaaatagacttatacagacctaagtcccttagaaaaagtaattcagtaacctttaagcaactgttttcatactcagtttaattgggcagtgatttgaggttgtagctgaactcatatctgtgtatatgtccattgctcaaggttgaaaatttgcttgagtattagtttccgctcttattgtatacatgtgcatatattccagagttaaggaagcatatcttgcaagcaatgccagcaaaaacataccttttgtggagtgagcatgagataattcattttgtttcatactttatatagccaattagatgtgtaaaatgctgtcatttgccaagtattagaaataaaaatgagagatacttatatttatgaaaggtaagatgtttttccatctttcattggaaatggacaattagctacaagtctgtttccttgctataaaaataaatatccttacttccaagaagatgtggatctgggagaacagaatgtcaggctgggttcaaactaatttgccctacttctttggacccaatgcataattatcttaaggatcaacaccctacattttaagaacttgcctgtctttgtgctgtttatatcttctgtattctttcctctttcatcttcaatatttagtgcagctatttttatgaaacgttagcctgtgggaattttgaacagatttagatagtagttttaaaggataagtggctcaacatttgggggaaagttagggtggcaggagtggtaaataaagtaaggaaaaagctctttcctatctttcccagcaggttcttcaggtctcaggctagactttgcccaaatctggttcagaatctcatggtacctgtgctgacttgctgtgttaccctaacacattgcattggaattgttattccttgtttttttttttttctttttttttttttcctgtttgtaatgtgaactctttgagggcagatgacatctctgttttggtcaccatcacatcagcgtttgtcacatgtacatatctgctgagtgaatggacagataaatgaaggcattaaatggtaaactacaggcgtcgggggagaaactgaatcatagatgacatatggagattcactttctggagcaatgctttcttaataccttcaattgggttgattttctttttgaaagagtttatttcttgacactcggaagggtgtcaacttacatatgaagtatttcaacagggaagcacactgcatctcctcctgcattttaagtgtgacttctactgatcagaatcatctccactgggcaaagagcagtgcatctcactttattccagtgctgtatcaaatgtccatctgtttgcaagtatagatttaaatctcataaattctgtaattcggccagaaatttctggctgcttccaaatatatacagtcctggaacaagtaatatggctttcaaagatgctgtctcaagccacattattcctgaacgaatatgactcataaagtatttgtgcattcttgagcatcctgaatccataatgacatgaaccacagaaattacatcagaaatataatttccaaattaattcaatgagtgttttcagtgacaacaaatatgtggaaacatcatttgtgcctgtcagggttctgctaattgttaacagcttaaaagcattgagcctaaaggcctactttcctcatcatctcttcgaaccccttcaccaatttcaagtctgtttctcctcctccattctagcttctccgccaagtacagcaaacacaggacgtgggaagtttggaactttggggctagtaactttaaaataaagacagcagttcttacttcaatgcattcacaacacactcatgacacacagcgcactccccatggattcagagtcattaccttctttgctccccctcctgtatgtctcccttttgggcagtatcattccaatcttgaccaccttcccaaaagacccattgtccactggaatcctagttctatattctggaagaatgcctcctcggtataactctgtgaataccagtgtctatggaaataaaatctaaaggtttactaatgaggtgcactggtcaggggacctttgtcccagaaaccactcccaagccatcctgcagaagaaagcttccttctcagggggtgctctttccatggcttctgtgacctgtgttttctgggtttccctccctccactccaccccatcggctttgtggattctctttcttttcctgagctgcttagggagatggcctgggcccttttctattctcactgggacacgactcactaatccatcgtatctatccctatggattcagttcctcttctgtgctcatgatccccaaatctctatttcctgactaaagccccctttatccaggttcttccttcacggcactctgactgtctcccacgcctcaaactgaatttgactaaaaaggagtcaagaatctctaccagactaccacctcccccaccaaaacaaacaaacaaaaaaacaacaacagcaaatatgcacagctcccctctcttctcattaagagactccactctgcagttgttcacccccaaatctaggaggcttctcactctctcttttcaaagattcagccctgttaattatgttttctttccatttctcaagtttatcaatttctgttcttccttatactgtcatcacactgattgaagccacagtgtgtcctagtccctcagcgatatccttgacacaacagttagtgaatcttaaatgcaaatctgattgcattgctttaggcttacagttcttcatttgctttctgttaatttaatgttcaaaatctgttttatggggtataaagcccttcaaaattagcccttcataataattcatattaacccttcacataaagactagctttcatttttgttttttattcaacatttactgaatgccgatgatgaacccaagttctgttgttaggtgttacaggtatagagatgagaaagacagacaagctctattattaatggagcttatactcaagttagaaaaacatacaataaaagcaaacacatacataagataatttaaaagaagtgttgtaaagaaaatttgggagggtaacgatatgaaagactgggagaaggaggctatgttagatggcagtggccagggaagacctccctgtggaagggataattaccaccttatgccagtttcttaattgcttattatgtagtagctatatttcccttcttttagtttttgaaacctgaaagcaattgacaagctccactctgcctcagctgctttgtatttactttttttttttttttttttgctattactttggactggaaccctccttctttgggtaactactgttcatcctgtaggtctcagcttgtaagctacttcttcagggaaactatcttcaaatgcccaggccagaataacgcatctcagcatcccacttccacttttttcaaaggtcactcattacaacaataattatatttatttttgtggtagatcctgtaagatgtctgctggctagcaccacttgaatgccccaccatcagttaattactctatcctgcaagttttaagtgctttccactttccaaaaactttgattagaaggatgcaaaaattagtatgtccatgaagatttgaagatgagatgtctatcctaatatgttaacaaaatatgtattgatagcaaataccaaataactccattgtatcattgatttcgtctcactgtactgacattatccacttatgtatcttctgcttttaggctgttacattccatgagctaagacaaaggccagaccttatgcatttttgtatctctaggatgcagcacaaggttctttatggtaaaggctctcagttgggttgactcctgtgtattgacttgtaatcactggccatttattattagagaaataattatattaactaatatgccaggaaatgctcttcatacagtagtgttcatatggtaacacttaatccccacaacaatagagggaatcatccttattttaaagatgaggaaacagttgcagtgaaataacttgcttaaggccacatggctaccaagttgcaaaactaggatttgaatataactcatatggttccagagcttatgaacttaactactattctatatcacctagttattaggctgcttccatttaagatactactgcaaatcaacaactgtaaacaatgtaaattggaattcctctctgtatcttaaaattccaggctctataaatttcatctgatatttaagagtaatgtcagtgcacaaaatacatactgtaagatcctccatatttgctagctttgatcctaaaatctgacagtcaacttcctagtagacaacgtatgaaaagaaatggtcattatatttactagatgaaaacaaactagttgcccaggtgaagcaaaactattaagataagagaaatattttatcctacaaaataccatgtatgtcccccagcagtagtaaatatactaaagttgtttatgagccaggagacaggaggctattgtttacttgccatgtaacaatccaggaagagatcagcttgataaatgatcaatagagtacacaagctaggttattgcaaggactagtctttttcattctaaaaaaagttttataatttaggaaaaggaatataagcaccatatggtctgtagatttcttacacttttttccccaagaaattatgcagtttttcttttttgcaaaattatcattagaaatagagaaagcctgcctcttgcatctcaaataagaatatatatatatatatatattatatatatatatatatatataattggattttattgctgtcagtcatcttggttattaaacacagaatcaagtcactttggctctgagaagcagtcatgttcagggagcttgcctaaccatgagatttctccgtatctacccctccagtgacatgaggggtttgtcatagggaggattcaagctaggatacaatgcaagtagcaaacaaccacaaaatttcactggcttgaagaaacaaaggtatattttgctctcatactgcatgtctactttgagtcgaatgctgaccctgaaatggtgttgtcattgctatcctcacttgtaacacagcagcagaggaaaaccaagtcgctggtggttctcacatttggtcataaatgttccagactggtagtggcacaggttgtttctgctcaaagttcattagccagaactactcacagtcaaccctgatcacaagagcactaggagatgtaatcctaccacatgcctagaggggaaagtggccttcgtggcacagagcattatgataactccagagaaagtcaggagggcgatttctatttgtccttctgaaacaagaatcctcataagcacagaattgaggaacctgtggattatgatctgatcactgtgatatcttgaatagcacataaaggcagctttgttaaagagaaaaactcactgctttatggaaagaagctgtcaattaattagggtatgacaaagaataagaaatgtcccctgattttctgccaaaaatttcataaaacgatagtgtcaggtccaaattcagtaatatgaattgtaaggaggtacaaaaaagtagagtccaggtagtgctttgaagcactaacttaacctaagacagataatcaattctctagttgcagagagtaaagacaggcagtctgcaagccaaatttatgtatgagaataagtttgtttggactgcacaatatcttaaaaaagaaaaagaatatgcttctaagcacggaatgctcatcatcagttaaccatactgctcatccctcttcccttcattaattataccagaccactttgttcatttatttgtgcaactgacccctgaagtcatttgactttgtgctctttgatcctgatatggtttggatctgtgcccccacccaaaactcctgttgaattgtaatacctggtgttggaggtggggcttggtgggaggtagttccatcgtggggttggtttctaatggtttggcaccatccctctagtgctgtcttgtgacagagttctcgtgagatctggttgtttaaaagtgtgtggcaccttccctttcaatcttcttcctcctgctccagccatgtaagaagtgcttacttccccttcaccttccactatgattgtaagtttcctgaggccccccagaaacagaagcctggatagcccatagaatcatgagccaattaatcctcttttctttataaattacccagtctcaggtagttctttatagcaatgtgaaaaatggactaaaacaagtccagagaaatagatggtttgcatatatctcaggtaatccttcataactacgtttacttttgcacgaacttttgataggattattgaatagcagtaattttggatcatattccttaacaagtacattgagtgagctgtattataactacggcagtatatgctatggttgagagacctgccgagatgtatgcctttacttcagtccacatggaggtggtcaaaaggattttcctgtgaccaataaattcctgttacagcttatagacaacaatatattaatgggcaaagatatatttgatgtggctagctaaattataacccagatgaccattaatcaatggattctagaaatagaaatttaaatgtatttataaacagcatagtttaaacttaagaaaaagaaattgattaaaccagaacctggagtttgaatcacaaaatctcatctacacctacgtgtaggaactctataaggtaaatttccagggatcccttaagagagatagtttgtcaattcttttctcaatccaaacttgctttttatttgagaaaaaagtgtaataaaacatcacagtgtatgcttttgatgagctaaaatagccctttgaatagggtaattggttcttcctttaataacattcaatcctggtggattgccctagttcctcagaaatgtcaagtaaactgtgatgagtacttttggctgtgcgatgggcaagtgattgaagcctacagataactgctttttctctgagatatgccgaaaatgtctctgcttgtgttatgccttgttttgtgaggttttaatttcagatctcattgactattcatttaatcattcatttttaaaatacaaatttgtagtacccttaatcctacatttctccttagtgcaagaacctgtataagaattttacattttgtaacaggaaaaaataatattaatctcaaaagcatttcaaacttcattaagacctaaagccagcgagcaaggaatctggacaaaagaaaataataaataatgttttaaagacaggtgttgaagtggaatgaagctgatactgaaaaggcaaaaggaggtaactcaaggactactttctcggagcatgaataactaggcaatgaaacttacggcccaggatattgtgagtttcgacattctgacatttattatcctggagggtgactcacaacagtcttgctggtggaatgttcatgctgattatcatagtcataaccctcagtaaatgaatgatgcttctaacacaatatttatttttcacataagggatttttgttttgttttgtttttgtgaaagggtttttctctgtcacccaggctgaagtgcagtggtgtaatcataactcactgcagcctcaagttcctgggctcaagcaattctcctgcctcagcctcccaagcagctaggactatgggtgtgtgttaccacactttgctaattaaaaaagaaatgtggagacaagagtctcactatgttgctcaggctagccttgaactcctggcctcaagcgatcctcccacctcagcctcccaaagtgctgggattacaggtgtgagccactcacgtaatggtttttacttcatgagataaaatacaacagagaatcacataataacaaaacttcattgtttccaaagaggtgaatttaaccaatactttcgtcaccagacaaggaaagtacaaccaaaaagactaaagaattttgaaaagacacagttatctctgactcccacttcagtaactggagttttaccatcattttttctgtaggatgtagctctttttcttatatttaacactgatatgaaattgtcaaatctagatgtcactgaaaatgcttcttaggtgcatgccgttagacttcctggcatttcttaatatattacctttttttgatctactcaggctaaattataattgtgacctctcttttcttcatttttgtagtgaaggttttgtgcttctatagcatcatttttattgtaatcatataagttcctattcccttttcctctggagttcaagagcttcatttaaaacttcaaataggaatcatggagacagataaagcctgtaaaggtgtttgttttactctgattttggggcaaagtgctttctttcactggcgaagtggtagttttacattcacttttatcttttggggactcagggtacgattctaggatatatatgaacgtggtggatgacattgtttacgtagtctccaaattgcaaacatatctttgtttttaaacttagtttgatgtcaaagctgtggtatcatgccattttaaaacagttttaaagtttatgattcggccatatactttccctagttctatcagatttaagaatttatgtagcagccctgtctctatctcaagtacagagaaaatgcttgataatcattaatttttcagcttgatggaatctaatatttctagtaaagtaggtcctaagtaggtccttgatgaaatctagtaagtctagtaaaggaggtcctaagatgaaatgtagaactagagatatccatcaatttctatccttcttatcatagaatccacccatttttaggacttttttatttacaaaacagataattttttttatcagtaataaaattggatggtattcatatacattatatcttgtgataagggtatgaataaataattatttcattttctgggccttttttctttttccccttttttctaaattaatgtatatggaatcatattagctagtatgatccatgaacatttaaaaaatttagttgaatatgttgcttatatcaaacactgtatcataaagttaaatttattacacattctgtcacagtaataaacttaaaatgaactcacttggatcatgtttgtactgaacttgattgaagtaacattagttaactacattttcagtaaatattaaaatgttatgtttaaatggtttggaccaaaatattactgacaataataactattaattgctatattaataggaaaacctgattactatgtagctctcctgaccccattacattatcactaacacaatgtactctcctttaaaatttaagggtttttttttagaagaataagactgcgtatttgctaattagctatgaacacaacagtgaatataaatccttcatttttcttcccatttcctatccttttattgtaatcaaccacacatagatatctgtgtgccaacacaattgtggtgttcaaaaaatgtatcagttcaatttatattttctaatagttataatcatttttaaaattggtgttatgaagaatgaaaacttaatataatataaaagctatcctcattatttttcttattttttattatttttttgagacagagtctcattctgtcacccaggctggagtgcagtggtgcaatctcagctcactgcaacctctgcctcccgggtttaagtgattctggtgcctcagcctctagagtagctgggattacagatgcccgccaccacgcccagctaatttttgtattttttagtagagacggggttttgccatgttggctaggctgttctgaaactcctagcctcaagtgatccacccgcttctgcctcccaaagtgctgggattacagatgtgagccaccgtgcccagacgctatctctgaaaatgaggacagtttcacagagaaattgaaagggaaaaaatgagtggaattgagaaaggtaaaaggttctaagtaatcattgaccataaacagtttttggtgcagaatttgcaatctccacaggctaccagcttctgagcttctgtaaaatattttatcaaaaagccatatttgaaatttcaaggactcattattttttaatgtttagtagctgttttcaatgagatggccatagtgatgggagcagagaagtccacatagaatctccctaggatacttccctatttctttcctatcccttccacccctcttgtttttctgaacatttactgacaagccagagcgtggtctaagaaaggagaccgaaaacttaaacaaataattttcccaaggtagataagattatttacaattccctttttctttcttcctctccaagtcttccctgtgggtggagtgcactcttccaccctattgactttcggtttggccatgagacttgtataatttgtggaatgagaacagaagtgactgtgtgccaattctgagcacaagccttgcatgtttctgcttgccttcttgatctccagcactcctccatggaaagaccatgttacaggtccctgcagccccagaatgaggacacagagggagcagatctgaaacccactccacagcctagatccaagcccactcgaacagccaatctcagggcaagcgcagaagagatacaggcacctcacagtcctgtgagcaagaagaaatgttgtaaaccattgagattcagaagttgttatgcaggataattgcgatgtaactggattatcagccccaagtgccaagaatctcataatattaatatattgtgttaagagctagggtttggataaacttgaatctagagattcccccaccctgccaagtttctatctgtgtatgtgaatgtgtgcgttgtgtatagtgtgtgtgcatgtgtgtgtgtgcatctgtttgatatgctatgttcaaaagtctctgatatgataataagtttaaaagactaaaataaggtatgcatagtgacacttgtgtacttctgcagatgatatgaaacataaaacacacaacagacctggtccttagccagtctctatgaaacaggatgaaaaaaaatgatgagggtaggtctctaataggaattaattgattgttgaaatcataaaataaagggtaaggtgtatataatattgctgtatatttcaagatttctccagagttccctaatgtggattccttctagtactcagagtttacaaattaaaattatattttgtctcttctactgattttctctattcttacccatccccatacttaattccttcagtgccaaggtcttaactgaatattgaaatcaaatttatactaaaaataattgaattattattactatctcctctttcaaccctgatgaaatgaatcctcctaagaaggaggattttccatatctaaaaaaaagattacagaatgctgagatctcaaagagtttgggagtaaagttttggggtgagtgggtcttgcctttaaccaaactgtctaatatattctgtttatgggtagggatagccccgggaggggaacagagagagaagattttcagctggaggaagagagccaagcacaaatatatcttctttccctgtctttccaggctttcttccactagaaaaatcacctctattccacttcccaattcatttgtagtttacaccctaaagtctgagggctggatgtctttggtcagaactttggaagttcttagtttttgacaattccatgtgattgtcttgtaaatgtctccaagttaacatgttttagaaaagaacccacaattaacctttcccctaaccttccctattagtaactatcatctctacttgcctagttacttacttgaatgctacccttgactcctgcatttccctgaattttccatgttcaattcataagcaaatcctgtctgttttacttccaaatatattttttcagaaacatttacttctttctaaagccatctgctactctctagctctgttgctaccaatcttgccagatcatcatctgctgtggactacaatagcttgcttggtagactccttgctcccactctgcctcttctatctggtcttcaaacagaagtcagtgtaattgctccccttattaaaattcatcagtggcccattgctgcacccaaattaaacccaatcattaccaaggcctatgaagtcttccttgataggccccatgatcattaccatcttttctcactctgccccaagcacatggtgtaagaaagtgctcctaaagttacacaaccttgaaaatttgctgggaatagaatgcatatatcaccttcttatggccacctgatacagacactgcaaaaatgtaaaagagttcaagtttcaaggaatcaatcacaggagtgttcttgctttgagagactacatgcttgagttatcatgacattgtagaggctgatgcaatagaaaatatcagagaggaatatcagctctgtagttctctagaagctggctaaagtacattctttgagatttcattctctgagtcttacttaagcaatttctgagctctttcttatcttacaggagatgtattgacacagagcctagaccaaacactaggcaaagatcacaaaattatgatttattgtttcactgtcctatgttttatagtcaattttcctgaatgtaactttgttttcctacttcctagaaattgtcagtaggtaaattctgggtgttttagtggcaagactctcagacttctgagggttcttttgtgagattgagaacagaagatcttaaggtgcacggtctcacacatctgtttctaaatgcaagttataaagccctcacctcctgtctctctggcccaaaatagttgcagaatcagaattgtacttttaaagagattttctactcttttgaatggtctcatccaatagattaattcttttgtttatcctgggtccttggggtctgccctactaaaattgaatgtaagtaattaattatgccaaacctcctattcctgacttatcttgaattctaagatgatacagtcaacttcttttaaggtatcactttctcaatcaattccttttgtgggtcagagtcacacctgtcatcacatttttagatgtcattgtctctatgatcagagagatagactttgtacacatgtatgtgtatagctgaactcatggctgaaaatttatttcttctgtaagttcttgtggaaattaaagccttttaaaaatgtctcctatttcttgagaaaaaaatacaaagcagtcctagacattcttcttttttttaagttgtgcctccattctgtgtttttaatttattgcttgctttatttctgcatcctctactcacatttccatgctcccccaattctaccttactctctgtatctaaacgtctttctgttgtgccttgtagaagccatagattctcctttttctgactgacagcatacagacaaatgagctttcatttctgtttagctcatgaagatcagtgagtaaactgacgatttcctttacaaattaactatgaaatttccactattacccagagctcttgcaacgtttatccttacgtaaataagcattgagtattattagtttacatttataaacagatttataattttcacatgaaaaatattttagaaaacactagttgatgcgaacaattttgaaaatacaattaattgttaataaaagtagacattattaggaaagacaaccattaacttttagtgaggcagagcatgttaatatcatattttaatgataaaattcctattttcaatttttatttatatgggcatttcaatctaataaattgaatcatagaatgaactaatagaaaggactaagggagccatgacaatagatttataatttacttggtgtagcaagaagatagcatcaaatgcacacaaaaaaagttaatatgattttattgcattgaagtacttcatttcaatgaaagtaatagtaaagcttcttggaagctatgcagaattacttaatttagatgacagaaacttcttcttagacgtcattttaggggaagaaaataattttctatttctatgcagctaaataaatgaaaagagttttatttcactatatcttatgcaaagcaatattgggtcttttacaaacctcacagagggaacaattttattttaattctggcagctcagcatggatgaaaatcgtggaattagataaggtctccttcctattgacttatggttacttaaaagcaaaagggagaaaaaaacacaaaaataatatataccatattgggctcagggtgcagcactatgggcactctgataaaatacttgtagtataattggtatatttcttctggaaataaatttggcaatacatatcaatgcatatggctatcactgcagcaattctgtttataagaatatatgctaagaacataatacaaaatatgtgtaaagctatgtgtgtgtatgtgtttgtgtctatatatggatatatatgtgtgtttccataaaatatgtgtgtttataaatatagatgatatgtgtgatatgtatagacacaggcacacacacatatacatatatattcatatatataacatttattatagtatcagtcctaagagtgactaagtaaattatggcatatccatacaatggagtactatgccaccatttaaaattaccatgtagattcaacttaaatgtttaatatatttctaaatattttaaaacctattgatacaaataattccatagtgtataagagtattattgatatttaaataattgggaataataacacaaaatgtgaatagcggatatcactggtttgcagaatttttttcatttatttctgttttacatgttttctgctttggttatatattactttaaaaaccagtaatgccattgaaatgccattgaaaaatatctgaccaaagctgacaatgatatctttgcaagatttataagtgtgtgtgcaaagatgtgcatgctcattcagtgcacttacttttggcaaggaagctcgtgatcctgaactctgtgtagtcatcgttagcacagtggttatccccagagctaccctggccggtgctgcatccatgttgatccagaatgaaacccaggatagaataacaatcaggagactgggaatgtacatctggatcagatagtatcccatttgtcgctccagatggaatcgcacttctatacacgtaaactttcctaattggtggtaaggtaaatacagcaattagtacaaataggtctttgttacggcatcaaatatcacaatttctcttttttttttgagacagggtctcactctgtcccccaggctggagtgaagtggcatgatctcagctcactgtagcctgcgcctcctggattcaagagtttctcctgcctcagcctcccaagtagctgggattacaggcatgcaccaccaagcccggctaattttttttttttttgtagagatgtggtttcaccatgttggccaggctggtgtcgaattcctgacctcaggtaatctgcccacctcagcctcccaaagtgttgggattacaggtgggagccactgctcccggcctcacaatttcattttgataaggattctgttataaaactttccatgacaatgaaaagagtctcgtattgattcttgaaaaaatatttttcactgttagcatcaagaagcaatgtagtaaagagagcgtactcttttaggaaatagtaggaaactttattacttccgacttgaaaagtgctttacacttgtcaagatatccaaagatttattatttcacttgattacgacaattgcttctgaggcagacaggagaaatatatacttattatataaagatcttctttactcatagactgtttctggtgttttgagtgcttctttagagccaggtgctatttgttgcagaagcctttccattttctttaaagtaagtgctagaggataaacacaattgaacacgaattattccttgaataataaagcaaacaaataggaaaatatgtgttatttcccattaataaatttgaaaataacttaaaaacacactaaaaacaaagggatccatttgtactatacacttatgcttttatgtctctattatttacctctattttggtaagcaatacatagaggagtaaatgatggtttaataaacattaagtcgatattttttgcttgtgtcctggttctactccctactctattgatattgatttatactactctatgttatctctcctttataaaaattgttcttctaaatcacccagttcttggtttaattgtttttatttgagttatttcaagaaggatgaggtcagaaagttaacattctgctctttaagtaacattctgttacttatgatgaaagaaagatgttaaagagcaattgctgtcctattgctaggtagggctcagtgcaaagcttctattcatgtgacttgggccgtgcgtgattgcacaggtgatgcacaggcactatatctggatgaacccatgcatgtgtttccagagcttaagtctcaacaaaagttcataaagtccagaaaacgtggattccactcttaagtgaatagcaatcagaaacatatgtgcaaaccatacatgatccttttattgatttatcaaatatatacaaaatgcctaaagattcctgaaatatatgaaaatactttagattttaaagtgctattaaatataaagatttaaattttgctatgagaaataatgaaatggaataaaacaagaataactgaaacatatttataatatcagttaaataactcactaagtaatcccatagcataattagtaacaaatactaaccattcagatactttgtataaattctctaaatttcaggtgattctcaaggaaaaaaataagctccactgtgtttttatttaaaaagagtgtttttcaaagttcaaaatcactaatcatcagaaaaatgcaaatcaaaaccacaataagtgcaatcccagcactttgggaggccgaggcgggagaatcatgaggtcaggagatggagaccaacctggctaacccggtgcaaccccgtctctactaaaaatacaaaaaattagccagtcgtggtggtgggcgcctgtagtcccagctactcagggggctgaggcaggagaatggtgtgaacctgcttgcagtaagcggagatcttgccactacattccagcctgggtgacagagcgagactccaactcaaaaaaacaaaacaaaacaaagcaaaataagatattatctcaccccaatgaaataactattatcaaaaaggcagaaaataacaaatgctgatgaggaagcagagaaaggggaacacttgtacaccattggtgggaatatagattagtccagctaccggagaaaagagtataggagttcctttaaaaagtaaaaataaaggtaccatatggactacggggtatatatccaaaagaaagaaaatcagtgtattgaagagatacatgtttgttgaagccctattcacaatagctaagataaggaaccaacccaagtgtccctcagtggaagaatggataaagaaaatgtagtgtatatacacaatggaatattattcaaacaaaaaagaatgcaattctatcatttgtagcaacatggatagaactagatgaaataagccaggcatagaaagacaatatcacatattattattcacatgtgggagctaaaataattgacttcatggttgtagtaaagcaaatagtggtttcgagaggctgagaagaaggcaggtgaagaggttggtgagtgggtttaaaaatacacttagaatgaataaattctagtgttcaatagcataatggggacaattacagttaacaatactttatcgtacatttcaaagtagaaagaagaaaagatttggaatgttcccaacacaaagaattgataaatctatgaggtgatagatgtcccaattacccagatttgatcattacagattttatgtttgtatcaaaatatcacatgtacctccaaaaacatgtacagctattatgtatctataaaaattaaaaaatgtttttataatattgctgggaaagaaaataaagggatacacacatgaacacaaatatacaccattgcttgtacataaataaatatactcagtatatgtggatctgatgagataaaagaacaagttggacaaaaaaatccatcacttatgcatggcagcagaccccagaaatacagtgatcaacagaataaatataatacaaacttagggcaatgaaagaaacatgcaaaaaataagtaaacataaaattgaatgatataatttcagatggtgaaagcagaatttgggcgtttaacacatattgttacatatggatgtttcaagagttggcatttgaataaccctgaagaaagtgggagtattaggcttggaacaatttcaggaagaactttacatgcagaaggaagagcaagagcaaaggccctgagacagacagagatgagtttggtgtatataagcaagcaagtcattgtggcagggtattacggagcaaggggaagagaggtaaaagattttggagaaattattagaaggagacagatcataggatgctgtagcacataactaataaatacttcaggatagtgaaaataaaactgaataaatcctctaattttgtgcaattaatttgtgtatgaaaacatttttaacttaagtatatttcattttctggggggaaagggtattttataaatgtggttcttaggtaacctactattgttgtttgttgtattttcacaagcaacataaaaggtatatgtggtatctaggcctattattggaaaacaaaagattcttgtgtaatgtaaaagcaaatatgaaatggagtctgggatctgaagcaaattaaccacatacttgaatgaggactctatgagatgcttttattctctacataatttgggcacgttattttgcttctggacagtacagtgcttctagaatgtaaagttgtaagatctctacgataccacccaagatgtcccattccttgcttatagtaggcattcataaatgtaagttcttttcctttaagctgtaatagctcatttgataactcaaggaagtatgcaaacttactttacactaaggaagtgtcttgagaccctctatcataaaaattcatccctaattgatgtttataacttcacctcttgttctggattaaatgatatctccctaagattcatgtccacccagaatgtgtgaatgtgaactgacttgaaaataaagtatttgcagatacaatcaagttaaaatgaaattgtcctggataagagggggtcccaaatccaacattacttatgtccttatagaaagagggaaatttggacatggaaacacagacacacaggggaatcccatgtgactctggaggcagagactgaaatgatgcatctgcaagctgagaaacaaggttttccagaaataggtagtcaggaagagacagggaacaactcttccctaaagctttgagggaaagcacggccctgctgacaccttgaattttggactcctaccctccagaactgcgagagaacacatttctgttgttttaagacaccgtttgtgataggttattatggcagccctagaaaactaatatacctccctaagccaactctaggggatttttagcatctgtctaagggaactgagcaaggacagtgctattgacttgcctgctctttatctttgtgttgagatgttaaacttgaactccctaataagttagatatcagcttcatctctgagttaaaaggaaaatggtagtgactttttgatccgatattgtgaatttgctaaggagataagagagactagggactttgaatagtgaaaggtcacagcacagttctggaaaatgctgagtccacgatgaatcatagttactgtaatgaaatgataagaacagaagctgatgctagtgggaggtcatgtactcaccacaatggagtgatgcctcaatcatgggctgtttaatggcattcagagaattccattactttctaactgtatgtatacattctaactgtatagttagaatacgtcttatggaaatagcccatgttagttaaagcaactgaacagaatttgccgatgtacaaatatcacattgagtctctcaattcttagtgttgagaactatatctgatatttatctcaagtgtcttagtgtgaatagtagatgcttaggtaaaaatacactgaaatgcacgaaaatatgacaaagggaaaaattaggcaacaaagcttttttcttttttaaaaaatgcaatttaaaaaaaaatgttcttaacagatacagtgtttactgcccaagaatggttaaaaacacattttattgttcacagaaattaaaggaatagttttggaaacattattactatgtaattatgagcttttcattaaaaattatttaaagataattgaacaccaagcattactttcgtctcatacagaccaattatttaacaatatgcaatgaatcaaagtattcataggtttcaaatgcatccattttctgctatataagaaaaacattgatctatgaacagttaaataacttagcattataatgaagaaacatctggatatcataaaaccacaagtagtaagtgtaaagaacactactcaacccctacctgtattgtaatgtttagtgcagtatcgtaaatctttttcttctttcaacagaaactggggcaaagtgagtccttctgccacttgtacgggtgcctcatcttgccattcaaaaatgagatcattcattgtgtacccaactaggcaaaacataataaaaatatgaatagtctaaaaagggcattcaaagaaaagaaatgcaaattactttatagtcacataggatgagaagaccaaacagtgtcatcttatagtaactctgtggatggagctattcattgcccaattccgtttcataaatgtctgttgaagtctattcacgtggaactcccaccaaataatatgagaaaacaaaatggactcattaaaagtataccatggcatgtcaaaacttgaaggggcatgcatatacattctttccttgggatgggtagctactagattaattttgtaattttcattttgatttcattccatctggtttctccttactttctttcaaattattcaggactttctcaataaaaactgaaattgtcactcgttagaaaatgactttttttttttttgagacggagtctcactctgtcacccaggctggagtgcagtggtgtgatctcagctcaccgcaacctcagcctcctgggttcaagtgattcttgtgcctcagcctcccgagtagctgggactacaggcacatgccaccatgccctgctaatttttgtatttttagtagagacggggttttaccatattggccaggctggtctcaaactcctgacctcatgatctgcctgccttggcctcccaaagtgctgggattacaggcgtcagccaccgcgcccagacagaaaaatgacttaaacttagtgtaagaataaatgtcagaaatctcttaattatatacagattgctcaaggatttaggcatgttaattttacttctgctgtgttttgaatctctccagagttgcatgtagatagcatttatttctgtgcacttaaacccatttagaaaatatctacaaagcaaaaatggagaggaaatagaaattgattttttcgtgaagattttgatacacatttcatcatttaatgattcaccaatttcttagattaatttgaattaagtacttaattcaaagagagggtagcattcattattgatatatatgggcttttaaaatttccatcctttataaatagtcaaggtttgggccagacacattatatttttatcatggaaaaatttcaactccttaagccataatgttgaatagaattggagtattttctttagaatttcttgaacaggcaaatgaaagcttattatagaactcatgtattttcttttctctttggaacatctacaccagtatattgctggcagctattgtattttaaaaaaaagtatattttcactaccataaaggattctctttttccccctcatgaaaataaataacaacttggggttaaaaaaaaaagaaaaagaaaatgacttaaactataacatttgtgggggaaaagtactaccacataatgcctccttgatttaatcattaaacatgggacagtttgtggaagtggaaacctttgcacataatatcagggaattcaggatagaattgattaatggattttgtaataggtcagcagcctttagtaaactaaaatttcatatttctatatgggaggtatctaagaactgcagatttttatcttctccttccctctgagtgagaagctattgaaatgtatgtttaaagactactgcacaaaatgagtcaaaagtgaatgagacctgtgaggcagaattgttgttactttgatcaatgagtttcttgatgcacaattaccatggaggtagagagaggaggcacggtgtggcctctgaaccaagtcaaatggtcggtatgttaaaagcgcttgggcgcagtgtctcacatctgtaataccagcactttggaaggccgaggcgggccgatcagctgaagtcaggagtttgagaccagcctggccaacatggtgaaagcccgtttctactaaaaaacacaaaaattagccgggcgtggtggtgggcacctctaatcccagctacttgggaggctgaggcaggagaatcatttgaacctgggaggcggaggttgtagtgagctgagatcgaccattgcactccagcctgggcaacagagtaagaccctgtctcaaaaaacaaaacaaaacaaagcaaaaaaaacaaaaacagaagctccaggtctgtgaggcagcacagaagggaaatggtcccaaacaaattctcctggaaacaagcttgtattgtagagaagaggctatgtgagtgactggaaacaactggcatggagctggttaagctgaatagaacattgagtagggaaaggaactgatcaccttccaccctccccaatacctgggaaaaactctcccagacacagtgaaatctgctccagctgtggtggtagtgactggagccagatgccctaccacacttgacccctaggtatatctcacaccgtccactctacaggcagtggagatggtagtagcaagagcatcagtaaccagatctctttagactgtatgggattctgcttctgaagttttcagcagaagtatcatcagtgtgacggctcattatggagcaagtgctattcggtagagtttgtgaaagtcattgagattgaaggaagcacgcatctacatctgaattttgactccagaacagatgtgggaacctgaaggactgtcccctaggctgatggatttaacacagcagggacttaatacctgcttatactagaatacatttcattgacccctgcaattaataatgatttgattggtaataatagaaagctttcactttcattcataaatcctttaatatgtccattataaataccattttaccgagaaagtagatgcacatttctcaatgatttaaggatagcaaaataggcaccaattctaccttctgccagataagacatgtttctcattcttccacacctataatcactgaagacaaaatatatgagattgtgtcccaatttagacagatgaatggaaaaatgacctgaaacttcaattcatttttatattctaaatttttctcaagatattctgtgaaatgaaactagctttatgaaattccttcaaagacaagctttatttagtggctaatacaatttatagacagtatatgtatcttgcttttgtttaaaacagtcatccacattagtttaggtatgtgtatttcatagtcatactattctacttcactatggttcaaaaaatacttaagtttgaaaccagaaggaaaatagtaagaggccatggttgggggcaattcctttatttgagtaacttactggttgttaatgataacaactaagtggtaatattgtcttaataaactctcaaacataattttaaaaaatcaatacttttttacacaattcaaaatgttttaagatccttatgcttttggttggcagatctttatacaagtctgagaatgctaaagagaacagactggttaatgagatcaagcttgtgagctgaattacctgataccacaataagcttcccaatgaaaactaatttattcagggaacagacattaaccctaacttcagtcaacaatctcatatggtagctacaataaaacatgtaaaccaatggctcagggcaaccaaacgcttgttttaccaaatagttacttattgagtaccaactgtaaggaagatgtcctgctaggcttcaggcaatgtgagatattattgccgagtaaagagtaagtggcacgagacaggcagaaactgctgtgtgcatttagcgcggggttctgtgatatctacctaggcctcatttgagctggatcttgaaaacaaggcaggggcttcatataaagtatgcaaaagaaggtgaggcacttcaggctcaagaagcagcaaaatcatttgaaagaaactgcgaactcccaaggtttataatagcaatgggaacagcttcatttgtctagagccagtttgcatgaagaagcatataaagtgtcaaataatgtaagatgatgtaaagttcaaatttccagtttaaaattttgatcattggaatcttttgagcaaggggtgaaccacaaaatttgtgcttgagtagcattactctaccaggatcctttcatggaattcacaaggtcaaaactgctttcataaccataataagacatttgcctttttcattgagtcaacatttgccctgatgttgaaaaaacaatggtgggtaaaacttctagtgctttaacacaaataaaggggctggcaccaaactgtgctaggagttactgtatttttactgccatatcttgcagcaaaaacaatcccatttttatttatgaatgtctttgatccttcatgaaacagtaaatatcttacagtaaaaacaatgccacttttatttcggaatgttcttgatctttgatgaagcattaacaattattaattttagtaaatttggaccctatgtaagtaccttttaatattctgtgtgtcaaaatgggaagtctgcacaaaatactcagctgcaggctgtaatatgattctttcaaggaaaatcactggtgtgtttgagttgcaagctgaactagcttggggttttcgtgaaatactattttttatgtgaaaaaaatgggtggaaactggttactgtgcctaggtatttggcagaccattttctcaaagatgaaggaagtgaacttatctgaacttgtcatgttaagggaacaacagacagtatttgctgtcaatgataaattttgaactttgaagtcaaaattggaattttggagaaattgttgttacaccatgagcttcatagcttcccaatacttaagagattttttgatgggcttgatggtgacatccacaaatgtgatactttgatatgtacgatgaagtgtgtcagctgtttggaagatctaaataactcatcaatctgatattttcaaaatgaccaaaacatgtttaaaaagcatacatgaaagacccattcaaagtgcaaggtagacaagttagttttaatttaaaagagtaggaagagttcattgatatggtttccaattccacattgcaattaatctttaagagactaaaagttttttgccttcagaagaaggcaaaacaaaacaaaacaaaacgaaaaccctctcattcttctgcagtggtccacaaggattataagtcagaggtaacacttcagtagataatttaaccaaaattggcacataattaactatgtgtttacagaaaaaaaaggaaaatttcaaagttttcagtctaagtcactgacaagtagctatgcaacaatatttgcttgtatttcatacctcatgacattacagtagctttctttgaccatctaataaaacacctttcctccagttgctctaccttacctattttctgtttattttttccatagtacttatccttacctgacatcatatatatatatatatatatatatatatatatatatatatatatatatattcatcaggttttgacattatatatattcatcagattttttattttgttttcctactttgtcccctagaatttattctttatagaagcagagacttattctgttttagtcagtggcatattttctattacctaaaatagtatgtggccagcatatagcaggtgcttgaatatttgaattagaaatagagaagggataaaggggaaggaggaagtgtgtgtgtgtgtgtgtgtgtgtgtgtgtgtgtgtgtgacgttattttgggttgccttgaatttgagatggtagcagaagatgcaggtgttgagcctaagaagtctcaacattgacttatatgttgaaggtagttgaaatcatggaactagatattggaaatgagtttaggattggagatttaagttaagaatcactatctacatatactaattaaaattattgattatttgaaaacatcagagagggaatatgtaaatgaagaggaagagctataaagaatcttagagaacgcttaggaagagaaaagtgatgacaggaaagtaataatcaaaacagaaaatccaaagaggtacatttcagctaaatagaaatgagagtatctaatggaattgtctgatcataggattttaaggtgataagtttcccacaagcagaggctgggaaatcatttttcaggtataagagacattcaatgttttagttaaaactaactggtttatttaaagtagatgaactctaaggctttccaactctttggttttataaaacaattaaatatagctttacaaacctgtctaattaaaatgcactataaaataaaacaataagaagcatttggttctgttattgaaataggaagactcatcaaaggaatcaaagataaaatttagaaagaaatctaagtatgtatacacatctaataattgtactatttgcaagtattgcagtaagaatagtggaatatcaaatggaccatagcaatatgaatatctgtgtagcagcaaagtaagatgtagatataatcttgagagatgcggaaaaagcctctgaagcctgacttctttatattttgcataaatttatggagtacaagtataattttgttacatgcatagattgcatagcattgaagtcacggcttttagagtatccattacccaaataatgtacattatatccattaagtaacttctcaacctccccctcttcccaccctgtcagccttctgagtttcctctgtctatcattctacactccgtccatatgttctgcagcactatccaccgtagcaaagatatggattatttatgaatctacaaaatgctctaggctaaccttgaatgtaaacaggctaaatgccccacttaaaaggcacagagtggtaagtcgcattaaaaaaaaaaaaaaaaaaaaaaaaaaaaagcaagacctaatggtatgctgtcttcaagagacctatctcacaagtaataatattcataggctcaaagtaaagggatggagaaaaatttgccaagcaaatgaaaaacagaaaaattcaggagttgcaatcctagtttcagacaaaacagatttcaaaccattgatgtccatcagtggatgactagataaagaaaatgtggaatatatgcacaacggaatactattcagccataaaaagaatgaaactatgtcttttgcatcaacatagatgtaactggcggccattatcctaaataaaacaagtcagatgcagaagacaaataccgcatgttctcacttgtaagtgggaaaaaaataatgtgtacacatggacttagaagttatttaaacactataactttatttgtatatttgttttctgttagaagggcctacttctttattattttcaaaactacctttaccatgcatagacttttatatttcagattaatatccaattgaaaatcatgttagtattttcatttacattgcattgaaattatggctcaattctgagagaataacattttcacaataatgtatttaaataacctcaggaatggacaatttagatgaatggttcaaaacagagtccaaaatcagacctatgtgtggaaatttaaggtaaaaatgacactttttgttgtgtagtttttgtttgttattattgtatttatttattcagttttaaattttaggtttgagggtacatttgaaagtttgttacatacgtaaacacatgtcacagggctttgctgtacatattatttcatcacctaggtattaagtccagtatccaatagttgtcttttctgggcctctcccttctcttcctctcccacctcaagtagatgccagtgtctgttgttcccttctttgtgttcataggttcttatcatttggttcccacttataagtgagaacatgaggtatttgttttttgcttcctgcaattagtttgccaaggataatagcctccagctccatcaatgttcccacaaaatacatgaccttgttcttttttatggctgcatagtattcccttttctatatgtaccacattttctttatccctttatccagcttgtcatggatgggtatttaggttgatttcaagtctttgcaattgtgaatagtgctgctgtaaacattcgtgtgcatgtgtctttatggtacagtgatttatattcttctgggtatatatccagtaatagaattgctgggttgaatggtagttctgcttttagctccttcaggaatggccatactgctttccacaatggttgaacttatttacactctcactaacagtgaataagtgttcttttatctctgcaacctcagcagcatctgtcatttttttgactttttagtaatagccattttgactttttagtaatagccattttgactagtgtaagatggtatctcattgtggttttgacttggatttctctaatggtcagtgatgttgaactttttttcataagaaaaaatgtgctggccacttgtcttcttttgaaaagtgtctgtttgtcccctctcccctctcccctctctctccccacggtctccctctccctctctttccacggtctccctctgatgcccagccaaagctggactgtactgctgccatctcggctcactgcaacctccctgcctgattctcctgcctcagcctgccgagtgcctgcgattgcaggcgcgcgcgccgccacgcctgactggttttcgtatttttttggtggagacggggtttcgctgtgttggctgggctggtctccagctcgtaaccgcgagtgatccgccagcctcggcctcccgaggtgccgggattgcagacggagtctggttcactcagtgctcaatggtgcccaggctggagtgcagtggcgtgatctcggctcgctacaacctccacctcccagctgcctgccttggcctcccaaagtgccaagattgcagcctctgcccggccgccaccccatctgggaagtgaggagcgtctctgcctggccgcccatcgtctgggatgtgaggagcccctctgcctggctgcccagtctggaaagtgaggagcttctctgcccggccgccatcccatctaggaagtgaggagtgtctctgcccggccgcccatcgtctgagataaggggagcgcctctgccccgccgccccgtctgggatgtgaggagcgcctctacccggccaccaccccgtctgggaggtgaggagcgtctctgctgggccgccctgtctgagaagtgaggagaccctccgcctggcaactgccccgtctgagaagtgaggagcccctccgcccagcagccaccctgtctgggaagtgaggagcgtctccacccagcagccaccccgtccgggagggaggtgggggtcagcccccgccaggccagccgccccatccgcgagggaggtgggggggtcagcaccccacccggccagccgccccgtctgggagggaggtgggggggtcagccccccgctcggccagccgccacgtccgggagatgaggggcgcctctgcctggccgcccctactgggaagtgaggagcccctcttcccggccaccaccccatctgggaggtgtacccaacagctcactgagaacgggccatgatgacaatggcggttttgtggaatagaaaggggggaaaggtggggaaaagattgagaaatcggatggttgccgtgtctgtgtagaaagaggtagacatgggagacctttcattttgttctgtactaagaaaaattcttctgccttgtgatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcggggtcctctgcctaggaaaaccagagacctttgttcacttgtttatctgctgaccttccctccactattgtcctgtgaccctgccaaattcccctctgcgagaaacacccaaaaatgatcaataaaaaaaaaataaaaaaaaaaaaagaaaagtgtctgtttatgtcatttgcccacttcttaatggggttgtgtgttctcttattgtaaatttgttcaaattctttatagatgttgggttttagcctttgtcagatgcatagttttcaaatattttctcccattctgtgggttgtctgtttacactgttgatagtctcttttactgtgcagaaactcttaaatataattagatcccacttgttgatttttgtttttgttgcaattgcttttggtgtctttatcatgaaatctttgtccatttttatgtccaggattgtatttcttaagttatcttctagagtttttacagtattgggatttacctttaaatatttaatccatcttgagttgatttttgtatatggtgtaaggaaggggtccagcttcaatcttttgcatatcactagccagttatcccagcaccatttattgaatagggaatctcttccccattgattttttttgtcagctttttcaaagatcagatggttgtagatgtttcatcttctttctgggctctctattctgttcagttggtctatatgtctgtttttgtaccagtaccctgctcttttggttactctagccttgtagtatagtttaaagttgggtagcatgatgcctctatattttgcttaggattgccttggctattcaggctcctccttggttccatatgaattttaaaatagtttttttctagttctgtgaagaatgtcattgttaattttatagaaatagcatttaatctgtaaatcgctttgggctaaccttaaatgtaaatgggataaatgccccacttaaaaggcacagagtggcaagctggatttaaaaaaaagacctaatagtatactgtcctcaagagaccaatctcacaggtaatgacacccactgctcaaagtacagatatggaggaaaatctaccaagcaaacggaaaacagaaaaagcaagggttgcaatcctggttttagaccaaacagatttaaaaccaaaaaagataaaacatgacaaagaagggcattacataatggtaacgggttcaattcaacaagaagacctaactgtcctaaatatatatgcacctaccacagggggcattgagattcataaagcaagttcttagagacctacaaagagaaacagactcccacacaataatagcgcgagacttaaacactccactgacagtattagtcagatcatcaagtcagaaaagtaaaaaacatattcagaatgtaaactcgacattggaccaaaaggatctgatagacctttacagcactttccacccaaaaccaacagaatatactttcttctcttcactacaaggcacataccctaaaattgaccatgtaagtggacaaaaaacaatcatcaacaaatttaaaactaatgaaatcataccaaacacactcttgaaccacagtgcaatcaaaacagaagtccgcactatgaaaattactcaaaagcatgcaaacacatgacagttaaacaacatgctcctgaacaactttggggtaaataataaaattaaggcagaaataaagttatttgaaaacaatgagaacaaagatacaacataccagaatctctgggacacagctaaggcagtgttaagaaggacattgatagcagtaaatgtccacatcaaaaagttggaaagatctcaaattaacagcttaacttcacaactgaaagaattagagaagcaaaaacaaatcaaccccaaagctagcagaagacaagaaataacaaaaatcagagtggcacagaaggaaatcaagccacaaaaaagccattcgaaagccaggagttgtttttttgaaaacattaataaaacataggccactagctagactaataaagcagaaaagagagaacgtccagataaatataattagaaatgatgaagagaatgttactactgactccacagaaatgaaaacaaccatcagagactaccatgaacacctctatgcacacaaactagaaaacctagaaggggtgcttaaattcctggacacatacagtttcccaagaataagccaagaagaaattgatttcctaaacagatcaataacaacctccaaaattgaatcagtaataaatagcctaccaaccaaaaaaaatgcctgggagctgaaagattcacagaatggtagttctgaattttaccagatttgtacaaagaagagctggtaccatttttacagaagctattccgaaaaattgaggaggagggactcctcctcaacttattatatgaggccagaatcatcttgatactaaaacctggcaaagacgcaacaaaaaaagaaaacttcaggccaatatccttgaagaacatcggtgcaaaaattctctacaaaataatttcaaactgaaaccagcagcacatcaaaagctaatccaccatgatcaagtaggcttcattcccaggatgcaagattggttcaacatatgcaaatcgataaatgtgattcatcatgtaaacagaacaaaagacaaaaatcacatgattatctcaatagactcagagaaagcttttgataaaattcaacaccctttcatgttaaaaactctcaataaactaggtattgaaggaaaatacctcaaagtaataggacccatctctgacaaacctgcagccaacattatactgaatggtcaaaagctggaagcattccccttgaaaactggcacaagacgagaatgtcctctctcaccacttttattcaacatagtattgaaagtactaggcagagctatcaggcaagacaaagaaataaaggatatccaaataggaagaggggatgtcaaactacctctgtttgtagatgacattattttatgtctagaaaaccccatagtcttggctcaaaagttcctccagctgataaacaacttcagcaaagtttcaggatacaaaatcaatgtacaaaaatcactatcattcctatacaccaacaacagccacactgagagccaaatcagaaaggcaattcaatttacaattggcacaaaataataaaataataaaatacctaggaataaccagggagatgaaagaaagatctctacaatgacaattacaaaacactccttaaaaaaattagagaagacacaaacaaatggaaaaatatcccatgctaatggataggaagaatcaatatcattaaaaaaatgatgctttaaattaatgtggcaaaattttaataaatgatgatgagaaaaaattctatccacttagaaaaaggagtgacgcaaaaagaaaatctaattgtatttaaaatataaacataatttgtgctatacaagttctggattaaagtaaatgataatattttgtaatattggcatgtataaagcataatttttaaagaaaaacaaattttattatatgtatatttaaaactttactatgaaagatattgtaaagttgaaacgtgaataacatatggaaaacaacatatgtaacaaatataatacaatacaatataatttaatataatataataatattataaaaatgaaaagataattctatattaaaggtttaaacaggcaacttacagaagaaacagcaatggttactaagtatgcaggaagaaaagctcaaactaaaggaaatgaaaatacaacaaaatacaaatttatatccatgagattagataaaaaaccttaaatctgacattaagtggcaatgttaatatgagcttggtacaaaaatgtttttaaatttactgtatttttgtttgaaatatcttttggatttataatcattcatatagtataggtacatacacatatgtattcatagaaacaaacacaaatgcatatgtatgacagagagagagagggagagaaagtaaggaagagaaagtaaaagggaactggtaatgaggcaaacaaagtagctaaggctagaaaggaggattatgagtagaggctactaatgcattcatttttgtttgtttctcagtttctattcaaatttcctagcacaaacataccagttttgaagaatacattcaaatttattacattatcactttttaaaaatcataaaatctttggtggtttaaaaatagcttaaaagactacacatgagaaaagaggttatataaaactttacacaacgggtaaatatataaaagaagcacttattcaaagggagaatgtgggctgtgaatacacttaagttgaaaacgagtttaaagatttactaataaattatagattcacattttgttttaaaagtaaaccagaatcatatttggtccagctatctcaaaagttaggcagggttagggtggagacagagagagatttctagtttgacccagtttgcaaatgcttatgttcttaattagcagctggaattcaaaaagcagaaggaagaaaatgctcactcttggcacatgctgactattgctaggagaaatattgctcaagtaaatttcattgacctgacaaggaacaactgctatgtcaaaacgcatttaactaaaacatttttatttataatttgtgcatttcatttgaatactcttaccataaatcaggccattacatgtggtttcatttaaattattggtctggtaaattaagcatcttcttagcaattacattttctctaaaacttctggtatagctgacctatcaccattatcttatgagacattttaacgtatatcacagacttaaagtttccccctttctcttgggaaaagtgtggatatataatttgtgacccctaactgctcttcttaaatgacaaacacaacaataactttgttcatatttctcaaaacttcacaaaattgccacactttgaacacacaaagtttaaagtttttgtgagaaatttcagtgaaaatcagaaaatgacctgaccctgagcccattttaatgaggaaaggcatcgtggttggttggatttcactgtaggagaggttataagagggtcttgcccgactacctttttggaataaacttcaggttgtgagaaaacattctgtgtctgcctcccaggatgttggaggttcagatctgctcaaatttgtgaaataatcaattcactaaataggccccaaatcataaccgacactgtgagccaaaccactttagcaatatctgaaagttgtgtaatgttttgaatagagaatagtaaggcaataatgctttgactggtcttgggtttttttatttttgatatatttatatattttttagagatagggtctcactctgttgcccaggctggagtgcagtgaagcaatcacagctcactgtagcatcaaactccgggacaaaagtgatcctcccaagtagctgggactacaggcaggtgtcaccatgcccagctacttttttgggtttttaatttttttgtagagatgggggtcttcttatgttccccagggtgatctcaaactcctgggctcaagaaatcctcccacttcagcctcccaaattgttgggattacaagtgtgagccaccatgctgtgcctgatcttgggatttttgaagcctgatttttcagtaccactatttatttgtaagaaccaaaacctatacaaaaccaaaaccaaaacaagggaagaaagttctgcataatattagcaagatgatccacttcaaattcatattgctggaagcatttgaagagtattattatgaaaaagtctttgtaatactataaaattaaaattttaacatgattggatagcttaaacatcagagaataaaattatatattttgtgtgcaacttctccttaaggtgagataaaaaatgtctattattgcaatatatttattgaagtacttgagagaggtaattagcatggtatggacagatttcaaacactaaaattcgcatttaatacacagtataataaaaactgatgcaagctattctggacagagacccagacattactgtaaatcatttattattatataatttgccatatatataaagccacattgttcctctcaggtctcagaagcttataattactttttttttttttttggagacggggtcttgctttgttgcccgggctggagtgcagtggtgtgatctcagcttactgcaacctccacttcccaggttcaagtgattctcctgtctcggccacctgagcaactgggactacaggcgtatgtcaccacgcctggctaattttttttgtattttttagtagagacagggtttcaccatattggtcaggctggtctcgaactcctgaccttaggtcatcaacccgtctcagcctcccaaagtgctgggattacaagcatgagccaccatgtctggccataattactttttaaacttactttttaaaatttaaacagaaaataatactgccagacaaggcaaaagatagctgatgttttacatgcaatcaaagcctacaatatcaagtatacctacaatgaaaatgacattggcacagaaagatgttcaagtaattggaagtgagcaactccacagtattctgttgcaccttaaaaatataattatatagcaaaatcatagctgtgtaatagaattatgcaggaaagcactaattcctaatatattgttatgaggactactgtaataataaaattctatctaagttagtatgttttcaaatgtggtatatcttttggatggaaggatcacttaagaagtatttaaggcatattagttgaagttctgcaggtcttaagttgctcatcacaaaggaaccagaacttcaaatttgtactgtttaaattatccttattttagagaattaatatttgttaaatatttaacattatttgttaattatttaattaataattaataatttatttgttaattattaattaataattaatgcattaattatttaattaatacttaatttgttaattatttaattaataatttgttaaacttaacaaaattatttgttaaatgattcaattgtgttgtaatccacactcccaggatatgttttctgtgtcctaatttataaattgttaagtatatgctgatttctatcataaaaatgaaaaactaactcaaggtacagagtttgtatagcccaaggatatattaaggctattttctaatggagatgacagaaacagtgattgtaattaggtagaagatgaagttttaatcacaaatgagcaagttaactatagccagagaaattttcaccattttctgtgtctttactgcaggcatagcttgttttattgagcttttctttattgtgctttgtagatattgaatattttacaaattgaagatttgtggcaaccctatattaagcaagtctatcagctccatttttccagcaacctgtcatcacctcatgtctctgtgtcatatttcagtacttgtcataatatttcaaactttgtcattattacgatatctgtaataataatctgtggtcagtgatatttgatgttaccattataattgtttttgggtgctacaaactacctccctatatgatggcaaattattagccaattaataactacgaagacctttaagtagtcgctgaaaggaaaagcaacacatctctcactttaaatcaaaagctagaaatggttaagcttagtgaggaaggtatgttggaagcttagataggatgaaagctaggcgtctggcacctaagagttaaccaagttatgatggtaaaggaaaagttattgaaggaaattaacagtgctactgcactgaacacatggacaataagaaagcaaaacaaccttattgaagatatggagaaagtttgagtggtctgcatagatcaaaccagcaacaacatttccttaagcctaaaccaaatctacagcaagatcctaactcatccatattatgaaatctgagagaggtgaagaagctgcagaattaaaattggaagctagcagaggttagtttatgaggattaagcaaagaagccctctccacataaaagtgcaaggtgaagcagaaagtgctgatgtagaagctgcagcaagatatccagaagacctagctaagataattgatgaaggtggacacattaaacaacagattttcaatgtagatgaaacaatcttctattggaaaaagatgccatctgggactttcatagctagagaggagaagtcaatgcctggcttcaaagcttcaaagaacaggctgactctcttcctaggggctaatgaagctgatgactctaagttgaagccagtactcattcaccgctcaaagatcctagggcccttaacaattattatgctaaatctactctgcctgttgtctataaatggaacaagcctggatgacagcccacctgtttaccgcatagttaactgaatactttaagcccacagttgagacctattgctcagaataaaagattcctttcaaaatatcactgctgatgccaattaacccagtcaaccaagagctctgatggagatgtacagggagattgttgttttcaagccttctaacatagcatccattctgtggcccctagatcaaggagtaattttgacttttagtcttataacttaagaaaaacattttgtccattctgtaaggctatagctgccatagatagtgattcctcttatggatctgggcaaagtaaactgaaaacctacatgtaacaattcactattctataatgacgccactaaaaacattcatgattcggggaggaagttgtaatatcaacattaacaggaatttggaagaagttgatttcaaccctcatggatgactctgaggggtttaagacttcagtggaggaagtaattgcagatgtggcagaaacagcaagagaactaaaattagaagaggagcctcaagatgtcaccaaattgctacaatctcatgatcaaacttgaacagataaggagttgcttcttaagcatgagcaaagaaagtggtttcttgagatgaaatctactggtgaagacaccgtgaacattgttgaaatgacaacaaaggatttagaatattacatgcacttagttgataaagcggtggcagagtttcagaggattgattccaattaggaaagttctactgttggtaaaatgctatcaaacagaatcacatactacagacaaatgtttaatgaaaggaagagtcactcaatgaagcaaactacattcttgtctaattttaagtaatttccacagccatgccaaccttcagcaaccagcatcccatcaatcagcaaccatcaacactgaggcaagaccctccaccaggaaaatgattatgactcactgaaggctcagattatcagcatttttagcaataaagtatttaaaaattaagatatgtacattatttttagacataaaatgctattgcacacttataggctacagtacagtataaatataacttttatatacactgggaaaccaaaaaattaatgtaactgctttactgtcatagtctggaactgaaccagcaatagctctaaggtatccctatattcaaatatattccctcagttttaaaacagctgtgttgggaaaatttgtgatactattggtgagttagaaaaaaaaaatcaccattcctagaaatatttttattttttgagacagagtcttgctctgttgcccaggctggggtgcagtgccgtgatcatagctcactgcaaccttgaagtcctgggctcaagtggtcctttcacctcagcctcctgaatagctaggactgcaggcatgcatcatcacacctggataattttttaattttttgtagatacatggtctcactatgtttcccagactagtctcaaactcctggcctcaagtgagcctcatgcttctttagaaaatattttaaattctattgatggtatatttgaatcatattcatatataaaggacatactatagtgaaccctcacatttaatgagttacacattataattacaatttctaatcaacagttctttagcaggcctggtgactggaagtggtatgaatctcccttactcacgcccagtgctaacacttgggcaaggttttgctttttgcaaatctgcatgtagattttcctgatagcagaactcagagaaatcaacaaattgccaggaactggggactataagtgggctatgttgtgaagaaacaggctacttggaacttctgagagctcagaaatttgatttggcattcttcaaatgccttagaaacttcaaatcctctggattgagagtggaacatttgtcatacaaacaatgaagaatccactggtgaggatctatgaacttggctgccctagaggtaaaagtataaaggaagcagtggagccattgccttcatgattcacagctcctgggctttgatctcagtatggtatcaaaacactcctaaagtccacctcactcatttattaatgtaaatgcttgaatcacactctgtgtaccttttcaaaaaatagattattttctctaaatttttattgacaaactattatttattatttccattttcctgttttctagtttggctggcttccctcttgatcctcactacatataattcacactgtttttgtttacttattaggttttgttttcctcttgatcctttttacagatattccatggttttccaatgctatgttcctaattcacagatttgtggtcttctatgtttaaagaatttatggaatcctagagttgagatgacttttgctgtcatctaatgccgctcacttatcttataaaatagaaaactgagcctctgaaaatgagcggatttatataacttatatagtttctcagtgaaagactgaagggtatgttttctgaattcctccttttatgcaggtagcagccaatgcactgcataatttaagggattgttgagattgaacaccagggtcctgtttggggatatgctaccaaagttttgaaaaagcattatctggaaaggccatttgatttaggggaattgaagggatatgagggttgaaggaacagattattttgagaattaattaaggatgaaagaggctgggcacggtggcacaggcatgtaatcccattttttgggggtgctgaggtggttggatcacttgagatcaagtgttcgagaccaacctgggcaacatggcaaaaccccatctctatcaaaaatacaaaaattagccagatgtagtggtgtatgtctgtagtcccagctacttgggaagctgaggtgggaggatcgcttgagcctggaggtggaggttgcagtgagctgaggtcacaccactgcactccagcgcgggcaacagagtcagaccctatatacaaaaaatggtgacagctctgagtagtaaagaatagcagcaaatggcaggatcacagaaataaaatgctttaaattacaggtgatctagggtgttctaaaaagtctactgattctcacacaaagaagatggctactatctgaatcacacatcctaacaagtgttggcaagggtgtaaagaaattggaactctagtgtactgctggtggagtataagatggtgcagctgctataaaaaatatggctgctttttaaataattaaaaatgaatgaccatattatctagcaattttacctctggatatatgtccaaaagaattcaaagcagggtctcaaaaaggtatttgacattcgtgttcatagcagcattactcactatagccaaaatatgaaagtaacccatttccatcaatggatgaatggagaaataaaatattatatacatacaatggaacattattcaaacttaaaaaggaagaaaatcctgacatatactataacatagataaactttgagaactttgttaagtgaaataagccagtcacacaaagacaaatactgtatgaatctacttatatatgaatttagagtagctaaactcatataagcaaaatgtggaatggtggttctcagtggcaagaggaagggggaaatggagagttgtttaatgaatgtagagttcagttttgcaagatgaaatagtttgggagattgcttgtacaacattgtgaagataccaaatactactgaaccgaatgcttgaaaatggttaagatggtacattttgtttgtatattgttatactttgaatgtttgtcccttcataactcatgtttaaattcggttgcaattgtagcagagttaagaggcgagacctttaacaggagattgggtcatgaggtctctaccctcataggtggaattactgccattataaaagggtggtttcagcccctttttgtgccgggcccttctgtcttctgtggggtgatgcaatgaaaacgccctagcagatgctggcagcttcattttggattttccagcctccagaactgtgagccaatacatttctatccattaaaaatgacctaatctgtggtattgtgtcatagcagcacaatacagactaagacatggattttaccacaattaaaaaataaaagaagaaaagactgatgaatttctgggggaggaaataaaagagggatgcacagtgtgcagaagaccttgtggtatcatgacatgagttgaaagtagaacctgggtaaatacaatgaattagcctccaatagtcttttcagttatgtaagagaagaggggagtcattccggacaaccaacttgatgttttctttaatggatctttgggtgaaatatggctacaagtgggctatattaactgcactgtaaaaaatatgaccaaattattgactgtcgttaagagaaacaaagagatcactgtcttaatttttgctagaatttctagtgataacaagtgagaaatgagagacattttccccgtctacatggaacttgcatgtagtggggtgggggtggggagggcaatacaaacgttatcagaaataaaataatcatttcagatggtgatatgtattttgaaataaatttataatttaatgggataggaagcaactggggagaagagagctaacttaagaaaagattatcacactttgggaggccaaggtgggtggatcacaaggtcaggaatccagaccatcctgtgtaacatggtgaaaccccgtctctactaaaaaatacaaaaaattagccgggcgtggtggcgggcacctgtagtcccagctactcgggaggctgagacaggagaatggcgtgaacccgggaggcagagcttgcagtgagccgagttcacgccactgcactccagcctgggcgaaagggcgagactccgtctcagaaaaaaaaaagaaaaaaaaaatgttcagaaatggcctggcggaatgatccgatgggtcaagctatcgataaatcttcaggaaacacattttaggcagagagaagagcacagttttatctgacataaggattatggtaaccccatcattaataaccacaaaagcacaatgttgaaataaatagataagcatttcatttgacatcaaacatctttgtaacaactgaaaaagtatacaaaagtgaagtaaaggaggtaaatgataagccaaacacaacattgaaaccaaaagtaacaataaatattttcttgatgtattcaggctatacatttaatttcatccatattgaagttgaaaatgcaaacaaaaaagggatcctcgggttctataagaatagaaagaaataggaaccctgcttgagcaggacaagagaaagataaactttttatctgtatcttttctccgaaggaaaataaaattccagagcatgaagatgtttgcagatgagattgctgatgctatatggaatctcaaaggggtgataaagaattttacaaagctgctaagagactaatgttgagaatattttcaagtttattaacaggtagattctgtgaattttaaaggagcgtaacaccaaatccatacaattccagaatagttaagattatatctgtgaacaggtagagcaggaagctgtggtcagtaggagccagaattagggtcataaaggaaaagccatgctacattgatatcatattataatcttattaccaactatgctagaatattaagggatactatagtgttctcagcaagatatctgatgaattctaatgttattcttataagcaaggatttcaaaattttgaaatggatatccatttaagtaatttatagctgattgaaaaagcaattgttgatttttttcagtagtaataaatcaagacaaatacctgtagtgcactgttgcaaggttttcagtcctgtccttctgggagtgtataatgatatattgttcaattctctggatgattaaccagcagagacatggatcatcaaagtagaattatggactaaaactagtaagatgatctttaactagaaaaaaggtaaagtactttgtatttattccagtgaaccaatttagtaaacatggatgggggacatagaacttagttgtagtactcagatgactgtagatgtgttctgagtcaagactgttttgcagctatctctaatgtatgtgtcatctgaaactgcaatagtaacagaatgattggcactgtcacgggggggaagccctactctgcagtctcggtttaggccaattttaatacatggaaagacgtctaggggaagggaaataggcaaaggagggaactctaagtcttttcatatgagaaaacgaatgaaattactgggtgtgtttaacttgcagagataatttaaggataccacaattacaatttataaatatttggaaatcatcacatagattttaaaatgaccaatggttgtatgaaaagtttgtgagctattaaatcatatcgttttctctgtccacttcacagttgtgtgaccttgggaaagtcacttcacttctcgaagcataatttgaccatatgactgactgtagtcaatatgcttagaatacctgatgatcagtaaaaattcaacctagaaagatgtggacagactagaagagaatggccattggtgttgcataggatggaatacttaatgtttaagtggagatttattttataagtagcgagttcattactgtatagttttgtcttgggaggacttctgttttctagctaacactgtaactgcagaggtttaagcaacaaatactcagcaaacaagaaccatctgtatttctcactaggcaaacaaaaaacataatattattttgaacagtatccaaacttttaaattatgaaagagcttggataagagtagagactattataaaataattgcaaaaaatcatcaccaaatcttatcttttgccttagctaatttagcataaattccagagtaagcggtctgagtaatgtcaaacctggtttttaaatgaatctgagaaattaaatcataaaatcctctcatctctctttagaaatttctatcccaaaaccccattaaagtgtattctatctttatatatttctatccaacaatactactaaagtatatatcaagtttcttaaagcttttgttaattttttttttcaagttggcccttaacaattaccctgtaattttcgagatttaggctgttctttttggcagacaatacttcttcactgagtcattttcttatattgtcttttcaaatctaaataatattttaacttttactctttttttttttttttgagatggagtttcgctcttgttgcccgggctgcagtgcaatacattcctctttagatatgaactacagaattagaccctttatggaagtagtaatagtttatgcaccatgtgtcatcaatgcctgttaactattattctgattctaagaaattattatccaatgtttttccatgattaaaaaaatccttcctggcttttttttttcaactagcaaattaaaaaaaaaaacagttaggaattttccttttaatgtaaataaaaaactgaaaattcagttttgagtttttttcctgcctctagccctgtacatcaacttccatcaagcattccttaggggcatagtctagatcttaatataggtagttgtacctctttctcttctatatcattctatattagttatttcttttgcgtcaaataaaataattataattgcatttatgtaaaaatgtatttataaattgtgatataaatgaaaacgtatccgttgaaaattacctcatgttgctagcgcttcaaacagctttaaaaaattcaggtaatggcatctgataagtaatcagtaaactaatgcaatctaatcctgagaaggaaggccagtgatcactttagtagtttgtcttcactaggaactttcctcagtttcatttattacaatcaagaactgcacataaaaattggggctcaaatttaaaacagttagtgaaaaacaagtcttcattgcagaattctctgtgtggtatgtatggtttgatatttttattgttactttcttaggtttctcctaataaaatatgaattttgagaataaagtgtgaattttggatatgcatattgtcatgggaactggcctgtgtcttcttaccgactttgagagtgaaaaatgagtattaaaaagagagaaaataaatgaaagcaacacgttttcttcatacctaaaagcaaacatttatagtatttatcccagaatgaagttgaattaagtatgttctagatcagaggaataaacagtatgttgaacttctggcttttatacaagcagttacatgaaactctgttgagatttgaggaataagcacattcccagagaggcctttataatttgataagggaaacatccgaacttggaacatataaacggggccacattttttcctttgacttcagtggaattctcagtgatgagttagcattctaaattactgtaacagtaaagattcaactttagtgcagttattttattttgatttttaaatggcagcagagtgaaacactatgataaataccacttgtgttgcagctaatacatttttatacctaaatattgaagaaaacataatgttgattttcttttttttttttttacctttaatgagtctaccctccatgaataaactagattaatcatattttccaaatagcctctaggaaacatattgttaaaatatcacaaagagttccttattgtctttctctgtttcacttcttccagtttttctaaaacttgatgatgctgtctttctctggctctcttttggtggtcgttttctatgctatctccagaaatttcattgattttcatgtctgcatgcttatccatgtctcaataagcagtacttctaaggttgtgtctctatatttgtacaaacattcctaattcaagctctatcctaaaatttcccataactcaaagtaaatttttagttgaacaaaaattttcacaaaaaacacagcacagttaagcagacatcagctctgatctactttttccatgaatcaccttcttttttcagattaatgtaaacaaagctaaatatccagttctcccgattgagaggaaacttgaggaaatcatctttatgcataattcttctttttatatagcaaatatttgaacaggttttcaaaatgtttgttgttgttcctatcattattgtctccgctcttggaaattctcattaatttataacaaagttagctctttacgcggacgtttttcccccagtcttccttcttgttttcaaataaaggttttggctgagtttcctttccataactatgactgaaaaagatagaattgctcaggattttctttcattgcttttaagctggcatactacgattatttctatttcttcattctgtatttttgatattcaatcaacctaatttttttttctttaaataatttctccagggatgtgtctaggttctgagatttttcaaagcaccaggtttaggggtttttgtgattctttggacactctattgtgtctttttggtctttttgaatagaatgcttagtgaaatcatttttattaaaaaaacctggcttatttgtatctagaaattttgatatattgtgctttcattgtaacttaacatcaagtttttcttaattttcactttaatcaaatagtcatttagtatttgtttttcattccagttatacaagtgtatattaatatataataatgtatgggaatttgtagcaacttacagtaattctatattgttattggtttctaattttattgcattttagttagaaatcacattttataacatgttgattcataagaggttactgaaacttccttggtggtgtataacataaataaatgtttccatatgctgaaaacaaaatttaacaaagaataaaaattctctctctctatgatttgttttgttcaaatatactgtgcttgtacaatccagtaaattgttgatttatctgttttttatgcagttcatcctgcttttgcttattatatttagaagttatatggttacatacttagattttcctaattatatatatatatatattttttttttttttagagagagtctcactctgtcgcccatgctgagtgcagtggcaccatcttggctcactgcaacccccacctcccgggttcaagcgattctccagcctcagccacccgagcagctgggactacaggcaagtgccaccacgcctggctaatttttgtatttttagtagagatggggtttcactatattggctaggctggtctcaaacacctgacctcaagtgatccacctgcctcagcctcctaaaatgctgggattaaaggcgtgagccacggcatattgattttttaccagcatgccactcaagtgtttgtgcctcataatttttttctgccattaatttttttctggttaaaattattctggactttttcaaggtacatttctcagatatacattttttcatttttctttaccaaatttttttgtgtggtattcttagaaagtgtctagttgtcaacatattgttgggtcttaatatttgttaacatctagtttgagaatctctttttttctacatgaatttaacccttttattctatttttattctttgatattatccttaactcatactttttttttctcatcaatttctaatgcaagtcttctcttaccctggattttccttgcataagcctcttccccaataatttcttttcctctaactaggaattttgtatcatccatggtttcaattataagtcataaatgtacacttttgagggcataggatcattgatagtttagacaaagtagtcttttctaagttagttattcattgttaattttgttcttctcttattcactttctcctttgttttaacagtataccattaagatttgcttatcatctttaattgaattattatattggcataaatataatttttatcattatatttcaggtagcctctgaaattcttgaaacagagacttttttgctttatttattgttataccacccaacataatatgtggaatatattaggtatttgataaatatttttcaattgatgcctaaatgaaagaatatttctcaggccacttggaacagttttgaccattgacatatatttattgaacttttactgaatttaaggaagttgtaccattgcaagccattaaagtgtttgcttttaaattatgtttcctttttgcctacttcccacgtcttaatattattgaacattttcttttcttcctttctgcagtcagatttcattcaaaagtggaccctgggattctgacagctcttgctttccagtaggttaaactctttttgcctactttccagtgggttccaccgatttacaatcttttatcttgtcattttaaaccactatttaaggagaaaagaaaaaaatagatacaaattgttcttaaaacatgcatatatacacacatatatatgtagatttgtatgtatgagtatatatatacacacacatatatgcatatatatacacacatatgtatatatacacagaaatgtaggcatttcttaatatatgtatatattatatagtatattacatgtgagtgtgtgtatgtatatgtaattgtcctaaaaaagttttaagaaaaaaacgccttgaagaacttgacttcagaagcttctactttgactgacattagcatctgccacagaggtttaataaacaaagtctctatggttagctaaattaaaattaattcctaataagagagcaggaagtgcttaatgactgaaatattaaagaaccccttgaacaatccactcatatttcttatagaggaattaagaaacaaaggggaaagaaaagaggctctcttttctcatgttgagaaatgttctgagaaaggcagacacatgggaggtcttactatgtcagcttttgtgtcctgcaaaatagccccagtaagctttccttattcaaaacataagcccagtgatctaaccaaccctcaggcactgtactttttctcatctttctttaataactaacattcttggaataaacgatttcacttgctgctcccacttcctcatcactcacctaaaaacaaaaaacctttttagattccagctttgaccatcattattctaatcacatttgtcttcgttaacaataacaattgcttttttcaagtaccttacaaaactttctttgcagcatttgattttgttacacagaactccttcacagtcctttctctttcgaggttgaatcgtgttgattttaatttgccatctttgcctttgtctggaattttttccaacaacttctaaatgtaggcatttcttaagcgtctgttcttgtttgtgttttatttcctctctacattcgcctcttcagctatttcatctgattcttgaaccactctgtatatggcttttaatagttgatcttcacttttcactccctctttggctttagacctaaatttcccagacctcaaacatattaagatggattttatcaattgtcccatcaacatttgcttctcatcccctgttccctttcttcatcaatgcttctaatctgatccgtttatctaagctatttctctctgacacacaggcattcagtgacttcacaaccactgcgaatcagcctctcctgtttctaccttccacataattgctctttgtcctactttctgttctttttctggaaaattatgaaaacttcttaaacaatcttggttcatttaactaaaataatctttaagaggtacagcaaggaccaaacaattttcttgccccttatatgttgaaccattttagggtgccacttagagggtcccgcacattttaaactctttgccctaaatgtacttaatttttcaaccaagatatacaatcagcctgtcctcaaattgcccttcttcaatttcaaaatcaggtctgctgcttctccccatgtagattgattgctaagtagccccccaaattttaatttattttatttcctctcatttacgttagtactttatccatatgtatgctaattatttaagaactacttataaaagtaatcaatttaaattttccaaggaggagttatcagagaaattgatatttccacttcttaagaaaaaccaaacaggagagggaggggtatagtcacgttgccccacaaagttggtctgccatctagtgacagctccatcacactacaagccttgtctttgacacctggagtctgaggctcggccttcaaattttcctcaaggaatgtgtcaaacagtccttttattccccctcggataacatactgtcataaggtaaaatattgcatattgcttaatttttatatgagattaaacactgtaaacaattaatttaggactaattatatagatcagagaaagggtaggatgtgaaatgttcatctgtgttaacgttgatcagtgaggcatatgggtctactttgaaagaagaaatgtagaggaatacctgaaagcttgaataaatctgtgagaaagtgtgagacattttttcttctgagctaacatacataacatacccagcagagtgatattaaaataataaacattgcttatctgaagcagcataggtttggaggcagtttgtcactgtcacctttgtgagttggagccgaatactcaaccattcaacatgaccactttcacatttgaaaacgtagggataacaatatctttgttgtcagtataagaaaaaatatatatagacacttcgttgagaagaggctcccaataaataagtgatagtttgtttttaatgattaccatccttttcacttctgatgatgtgtatggaaacacatatctaaatatcaagctttgaaaatctgttatttttagatcctcaatttgtttctttctcatagtgtggagtgcatgtgttgataggtatcattattttcagtacctggtgaaaggttacatgcctattcagtaaatatgtgaccaaaatgattacaaaataaattatccatattaggcattaaaagcttgtatctactataatgtaaaagtattttaaaaagtaagtggttcatacttacagctttccagttgcattatacatgtttgtacatccatgggaaaattcttgagatccattggacaggaaagtgttaatgttaatctgaaagtcaaagtaattatttttaaaggaaatttatgacattatattaatattctattgtacaggagaaacaatgttgctttgctggtgactaactcagatttaagtaaaaatttctccagcttatgtatcctacttactataaaatagctatgcccttatatacaaatctggctttggtgggctgggggttggataattgcatatcttaggctggtgctaaagtaatcgtgggttttgccattaaaagtgctggcaaaacagcaattacttttgcactaacctaaatataagcatcccgtcatatttatatatctatatgtttatttattcaattagaaagggctgtggatgtctagaaaatgtctgtattccaagacgacatcctcaaaagagaaattcaagagtggatcctataaaattaatgccaaacgtcaaaaggtatctttccttgcaaatcacatgctatattccagaggcattagagttctaaacgtggaaaagcagggtggagaggagcaatcatatgtaacgttcagtcatcattctaacgaccctgatgttgtcagtgaacattcagcagtgtatttagtaaagtgaatctggaggacttgaaaagttcggcctcatgttccccggtgtgggataagggaatcatcagggtcaggaaatagccctctagaatattcatgatctgattctatgctcatcaaacaaacttctgatttggcttcacacaaaggataacctagatgctgtataccagtattccgctcattggaaaggctctcctccaacttccagagagaattagtatgttgacattccagaaaattcatcacctttgaatactttttgctggaaaagcattctacccagatctcttcagggtagtttttctggttcctacacctgaggaagagatggtgagatccactcaagtttattcaaatgaagttcttttctgagaactctttagcaagcctcttgcactgagaatattcccattgaaattcagtgtcttcatgagcaccctaggtggattagtttacttaaacttcgtgaccctaggcagattacttcaaatcccctatattgcagttttctcatctttaaaatgaagataacaatagtacctactccagagagttgctatgagcagtacatgcgttaacacacataagtgcttagacaagtgcttaagccatagcaaacactcaacaaacagtggttgttagtgattattagtatattcagccactcctagactccttcatttactcatctgccaaattctatagtgtgggcacaaagatgactaaattaaattacatattaagaactatttagccaggcgtggtgtcttacgcctgtaattccagcgctttgggaggctaagaagagaggatcgcttgagcccagtagtttgtgatcatcctgggcaacataaaaatactctatctctacaaatatatatatatatatattttaaattagccaggtatggcttgtgcacctgtaatcctggctactcaggaagctgaggtgagagtatggcttgagcccaggaggtcgagactgcagtgagctaggctcacactgctgaactatagcctgggtgacagagcaagatcttgtctcttaaaaaaaaaaaaaagaaaggaaggcatgcaggaaggaagggagggagggagggagagagagagagagaaagagagagaaagaaagaaaaagaaagaaggaaagaaagaagaaacaaagaaacaaagaaaggagggaggaaagaaagaaggaaaggaaggaaggaaaaagaaagaagaaaggaataaaaaagaactatttaagctttaacaaaaaatagtctgcagctctactaaatataaccacattcgtcaagctgacatttttatgtagaccatagacataaagttagaatgatgtatagtctacagagagtatgcttggtgagttaggtccaattaacataatttgggacacataaatggagagacagtgaagctgctgaattttaagagtcttaggaggataatctggtaattcattcgagtcagagtccataacacactagaataattcatggagttcaacattcaaaaggaatttttctcctggctcagctaggttaagtatgattgtgtaattttacaaagttctctcttaaaaaggcaattttaaaattaggtagacacaatgttttttgccttgtgaaagggcttattagaagtgtatgcacacatatattttgaatgtacacacattaattttccaaatatccaaggctctcagacagccagtttcaaatgttgacttgcagaattaattctgtgaccttttgtttggaagtaaatagcattctcagaatcttttccatgctctcaccatgcatgtgatgtcaaattcatatcctggctatttttctggcataaaaaaagagacattacataattctaaaaaaatagcacttgaaaggaattatttggcaaagaaaaacacagtttgtaggacttcggtcataaatcatatcctgaaaaaatctattcatcgacttttctttctttttgtttaaggtacaatacaattgctcctttcacagcatactgaaaaatacgtgtcaacttggtgggtttgatactgaatttctttgtcaaaacactacatataaattaaagacatgtcttgaccacatcaaaagaaaattaaatcaagaggcaattaatcacattctactgttttggaaataaatgtttacttgtgtaagagagacactaagttctctttctgagacaagatacataaacaggatatggcgtttcttcttttcctttaagaagtcttgggaaagacttttaacattagtacttagtgaaacagtaatgtttaaaaagctgataataatttgtgacaaacaattgacctcattaaaattcaattattgaccacttttgtacaagcattgtttcatgtgtctatctcaaccactagttgaattaaaaaatgtttgctgactctattatagactttgtatataaatgagtatttttattagatcctaatatttctctatttggtgtcttaaaaacaatggcttcaattagcaatttaatcagttttaatctatattatctgtaatatcatattagctaacacatctattagacaatgtttactgtgcagtaggcagtattttaaacactttgtgtatgttaactcatttactccgtactacaaatttacaagaataggtaaatgatatcaccctgttttagagatgaggaaacttagaggttaagtaactcacctgacattacacagcaaaaattgctacagctgaatttgcagccctggggttctagttctagatttcgtgctttttttttttttttttttttttgagacggagtctcgctgtcgcccaggctggagtgcagtggcgcaatctcggctcactgcaggctccgccccctggggttcaccccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcgtgcttttaacctttaagtatactgcctctcaaaagcattgaagcatttttcatgaaaatgggttctgtaattaatatgacattttaaattatgtatttcttataatacaagaaatgatatattgcatgcacatatcagttatttatagtgaaattatagttatattatagtgaaatttaaagtaaaacatgcataaataatttttataaaaacctacataaataattcttccaaaagaaatcagagaaatgtagttaaactgtagaaaatataaggaatttccccagagatttgatatatttgaatgatttggtatatgattatgaatgattttctaaggggtaaatcactcttaggagagattagattgctggagcactagaagggagattagaatgagcttctgtaacctacttctggagcttaattgtcatctgatcatagagacaatcattaactcagcaacccattaccaaagcaatctcattattgttgatggtttctttatgaagctatggaccgcttaagaaaaacatacacaattaaatgtatgccaaattcttcttacgacatgcattttatagcattgtaaattgattacccttgaataaacagcacttaaaaaagcaactgtcaaaataagtttgctttcttatttaaaaattaatggctatcaatgttaaaaatacatattctcatacaagtaaactttagttattttcacaaatttcacagagtgattatatttagcttaaataaaaattaaaattatatcatgatctttgtcaagttgctatgcatagcatctttaacataaaatttcttcccgtgatctgatttttaatgcaagaatgcctctgtactacgagtagaaaagttgggtttcttagtaatattagtaaagtaagaaagtatatcatatttaactgcctatgatgggattccattattctgtggtaaagatattactatcctctttttacaagtgacaaaactgaggctgagacatcttaataactcaagagtccatgcagtacaggtttatggattctgtaaaaaaacagaacgtatacttttctttaaaggtaaaaataacaactttagtgcctattgtatgtctggcactatgctgggtgctttatttaatgtattttaatacattatttcaggctcaaggtaattagtattgtcactgccatgtatctaagaaaaaatgagccttttagaagtaaagagacttaacccaaatcacagctagtcaatagcagagcctcgatctgggctgggagatatatttctccttgatcctcttgtgctcctatacctcctctagcttgtatgccaagactgcaaagctctaatcattctttcatctgagccattttccagggttgtttatgcagctgataattttgagagatgagaacatctttcaaagagaaggcttgcttacagcttgctataaaagtagtggattcccaaagtcagtggtagagagttaaatgtacatggagtatcatatcagggaaacaaactctagttttcctttataagaattaatagacaatttcaaatattttaaaaatcaagcatgatattacagcaacttaagtatatgaatgtgagtggtagacaaatagctaaacaaaggctacctctctgacaagccagaactgggtgtaaggatgggcagggcaaaagtacaactgttttttatatgttttatagaactgtgtgaactttgtgtgtgtgtgtgtgtgtgtgtgtgtgtgtgtgtttttgagatggagtcttgctctgtcatcagggctggagtgcggtggtgtgatcttggcacactggaacctccacctccctggttcaagagattctcctgcctcagcctcccgagtagctgagattacaggcatgcgccaccacgcctagctaatttttgtatttttagtagagacggggtttcaccgtgttggctaggatggtctccatctcctgacctcatgatcttcccacctcagcttcccaaagtgaaaactgtgtgaacttttaagtgacattcatgaattatataaagatttgtggttaaattaatattcagtgtttacatgttataaatatgtaattcttgctcctgattaagcttggtagtttgttatagcacttgtataactttttgttatatataacatatatatacacacatatatataacatatataacatatataaacaagtaataattatgttacaaatttcataaaattttaaatatatttaagaatgaggcactaaaaactatctggagctcagttagtagcagatggctcattgagtaatggtcttgactgtaggatagtaatatggctgctcagaggttctccaaatgccagaatgtgtagatcttttctcttaggcaaattagttttccagatacatatatatctatatatctaagacagatataaatgccatataactaagaggaaaaaaatatgtgtgtatatatatgtgtgtgtgtgtgtatatatacatatagatgtatatgaaaaaatatgtgtgtgtatatatatgtgtgtgtatatgtgtgtatacatatgtgtgtgtatatgtgtgtgtatatatatatgtgtgtgtatgtgtgtatgtgtatatatgtgtatatatataacaaatagggaaactaacttgcctaagagaaaagatctacagattctggcatttggagaaactctggacagccatattgcctatacctgtatctataaggtataatctatctgtatatctatctatatctatatctatatctgtatctatatgtatcatctgtattcttgtctactgctcagtggaagaagtttaagtctgcctttcagcattttagggccagcaaggggtcctgtcattcttattttgttggtatgatgcctcatgacaggtagcagttgtgcctgaaacccctatgcctaaagcttttgaaagagcctctccagcattttctgtcctcttgcttcctgcttagttcaaaaggtaaaaagggcagtccctaacctgagtgcatgggaaggaaatcaggaatagagggtccacttgtcctacaaagcttaaataaattatactcctcttagatctcttctggcctctactttctgaagtcccaggtgctttacatttctaaaaatttgaaaatattaattattctcttccttttgaattcccctatgttgacgtaggtttccactatctctgtctaagtcagttttcagaagtgcattcatttttaagtttcctaaacatgttatcactcatctgttgctgttttttccccattactttcatcctcctgtgtgttaacgacatttttattctttattccgtttatttcctttttttaatggggtttcagaggaaatacagataaatatgtaagttcaattagtcgtctttgcaaggaccttcttcttctttctttaaaaaagcaggaaagccagatctctcatgaaacataacagatgctccatttgtaaattcaacaagattttttctttttctagcacaatttttgttaacaaagaaactgaagatatgaagcatttgaagatttcaaagtcctgtgagattttcaaaaacaactcagaaaaaattaagttttggattgtgcaagccaggatatagcaaacaaaatctaggagccgagagaccatctgtttcatttgaattcatactgaaagacaaaagatgcatttctaaattatttcatacctttcttcaaaatattagaagaaatgtgagcaattcataatggatgatgtcatttataagagacaaaattccagttttattccaatactttatgacagaaaatacttgagcatttccaggggacatagtagcaagatctcattaattgtatttaaattatttaagtgttcaatataataaatttagtattctttaatataatgcatttgaatgggcacagttaagggttttagtacaactgtcatcttgaaatcttcttaataacaagatctatcctatttgacaaatttttaggatggacggaattaagcgcttttgtctttgatgacatattgttagtaagaagcctctcaaacaaaaagtagtctaggttttatattctattttgttcaatgatcagggaaatactaaaagctcagtagtgtgttctttgtgttgactttctccaactccaataagacttaaaataaacaaatacatgttgataatcatgtaagatatgttacatacaaacacacacaactacaataaataatctagatattctatctttgcaaaatgactattccatgctacctggtgatatatttttgcaacctatgcaaccccaaatctgtctgaagtgaaacagtacttcaaaatataattaaaaataaaatgacaccttttacaaaaataatttttaacttagcaggaaagaatgaaatttattttatttataccctgtcatgggtcccctgataatattcttgagcccacagcacagaggagtgaagaatcatgacctcatgttaagagactttataacttaaaatatatgtgtttaattcataagtgatacataacttgttatgaaaaattcaaacaatataaaattacatatagcaaaatgtacagttcccctttattcctgcccaaattccactattcctattcatttctaaattgtttggggttcgtctaaacttcttctatagacatatatatgtatatttttacatacatagctatgcatatatatatttgtgtgtgtgtgtgtatatatatatgtatatatatatatatgccttaaaaatatacaaaacatttttcttgaactgaaatatatcatgtaggcttacactcaggtctatctcatgcaagttatttcataatatggggttattactgtgttcagtcatgttcttattagtgaacatatataggcccttttttgttgctatttcagtgtttcagtgggtctctttgtaaaagatatcttatgtacacatacatatgtaatttagattcctagaaatagaaatgctgaattgaaggataaatgagtttcatatttttatatatcttgacaaatcctcttcccagttaacatcaagtcatgtgaccacagaagggctattagacagctcgaaatcttaccggtctcattaacttctgtcaatgcatttataaaaaaagttatctcatttgtttctttcattttccccttacatctgtcttataatttttgcttgaactgtcaaatataatttaggaaactcaaaatgagaaggaaagtctattgtattcactcatatttttgcttcctgtgtccttttttccttcttgatattcgtatgcttcttcttttatcattttcttttttttagaaagcttctttgaccatactttccaggcagatttacttgtgattaattctctattttcctttatccaagaatgttttgatttcccctttattcccgaaggatatattccctgggtacaagattctcagatgagagttccttcctttcagcacctaaaaaaatatttgtagcttctttctggcttcagtgacgtctagaaaaatctactctcattctcattgtttttcctgcataagatatcactattttctggatgctttcaggatttgtatttagttttcagaagtttatgcattatgtgtcttcatatggacatctttggatttatcttgtttgggaactcaacttcttgaatctgcaggctcacgccatttgcaaaatgtattaacatttcagccattgttttctctagttttttttagcttcataccctttccccctctatctgacactctgatgacatgaatgttagatcatttgttgtaatctcacagatccctgaggctgtttcccaggccccacggccaatctattcatctctgttgctcagattgggtaatttttgttattctgttttatggttcactgattctcttttccatcttctccattttttttggtccacccatacactgagctttcattttgattattgtatttttaggtctaaaattttgatttggtttcactttgtagcttctatttctttgctgaggctatttttctcatttgtttcaagcatatttgtaattgctcactgaagcaaatttatcatggctactttaaagtctttgccagatatctaacatttttgtcttttcttttgagacagggacttgcttttttacccaggctggagtgcagtggtgcgatctgggctcactgcaaccgctgcctcttaggctcaagagatcctcccaccttagtcttcctagtcactgggaacacaggtgaacgccaccttgcccagctaatttttgtgtttttttgtagagacagggttttatcacgttgcctgggctggtctcaaactcctgggctcaagcaatttgcctgcctcagcctcccaaagtgctgagattacagggtgtgagccaccactcctggcctcatctttgtcatttggatgttgctatcagttgattgtctttttccagaattattgaacatttatggttctttgtatgatttctggttctttgtatgatgaatgtttcttggttgaagcctagacatataaatactattttattagactctggctcttatttaaacttttttggttttctctgacattgctctgcttaggcaagggaaggtgttatcttgtgtctgtttcctaaccactctctatacaggcctgtgaggggagaggctccgccttattgctggatgtcccaggtgtaagcatgatgtccactgacactatggtgagagtggcctcagaactgctaggtgatgttgaaaatattgactgtccactaagtcttctctaaaaccacctcagcagagagggaaggtatgccttgtttctgcagggaaagggaggaattcctggctttctatgtggtcttcctggctctgtgaggtatgaagctcactataggatggtggggcatgaaaatccagttcattatttgtcctttcctgacactatcttgagttaggtgtgatggtacctcaataccacctggtaagactggaagtctgggctccccatttgggctttgctgtcttaagggggattgcatttcttcctgtggtgttgggctggagtagagcagttgtctaaagcttttctgtcttgctaggcttcccctttcctaacctctagggaatattagatttgctagagaaattaggcttttgttgggactttgatttttgtctgtacctgctgatgttgccatgttgccagtttcttcatcttcaagtctaggatgtacgaagcaaaaggaaaattctgggaattcacctccacgttgttcctcaggttccaaggtacacagccagcctgtgcttatatccaccactgggcatctccctaagtttgttatacatactgtgtccaggttttttagttgtacttagcaggtagaatagaaaaaagtatgtctgttccatcttccccgaagtgagattcttgctatcttttgatatttagtggtggggcggggttgggggaggggtggacttttggtaatttttttaaaaggtgcaaaattatcttgcatagacctggaattcaccattaatttactcatccatatgggagtatagggcttattagtggtggaacctgaaatcttcctttgtgccatatgtagcagttaatcacttaagattatattagtacatattagttgtttctcagaattctgatgaaagggtcaattcacaatagagtgatgtcaccctgtcacttttagaaatcaataaatctatggaaaagaaatctgttctcatgaactaggtaaatgtgaaaagcagacataatgtattgggatgcagagatgaagagcagacatgggataaagcattatttataaaaccactttgcagaaaaaaacattttcaaaatcactaagctattaagattacattttagaatcctactattttatccctgatattgggcatatgaactccaaatcaaatacccccattcctgatgagaaggaaagtttacaaaagagaagataagagagagataaaacagaatgaattaattttaagcctaagacctcaatattaagcctaccttgataccttttaaaacatgatactggtgaaaaaagtatttaaatatttggctcttgctagaagtataacatattctccctcttctaagagacatgacatgaattctgttcttacgtcctgttcttcacaactaaactaaattagaaaaacaattatggaaaatttttaaataatcactattttagaagattttttcagatgtgacaaagatcatcaaatatatcatgtaagtagctatttactgactctacatttgtttcatatttaatgaactgccaaagttaagtgaatcctagagttcaactgtcaaaaatttttattagtgtttattgtttggtattaattattattcaatattgggttttttttaatgctatacacttttctgataagtcaataattaggaacataaatgtaaataaggtcttttccagggattgtgattaaggttttgtcatccattttcacataatacagtgattttttttcttccctgccttgttcaaagtttattaacaaatcatcactttgcagcatgttagaaaggatgaaacttgaacagttagggcaaaaatgcaaaagaatgaccagagaagctcaaggatatttttaaaaaacaacacatatacctgaaaaataatctatgtagaatgtatctcagatgagaaacctaaacatttcttaacctgtaaatatttaaagaagacatatatacataaaagtattatcacaatgcatgattcagctgcctttcactttgcctttaagattcctgacaacctggctgatattaagaatcaccagggacatttgtttaaaaagtggatttccaagaattacttatatagttcctgaatctggaacttgggtctgttattattgatcagacatatttgggaaacagtctattagaggaactgaagtgcaacaatgatagcacttgttcaaaaatgtcaaaactttcaccaaacaaaccaaccaacaatacaccatgatattctatttcactgaaatcggcaatttaagtccacgactcaccttattgaataaagaacatttccatttttgaaaattcttagcaatttgttgtctgtagtgacttcatgaaagttggcacccttttcattggcaaagaacaaatcaggtttccaaatggagtccaacatggaggggtcgaggtctaaagagtcgtcaggatattcactgtacgcgaggcggggatcattccatttctgacgaagaaagatattcactctgtaatcctatgataaaataatgaaagaaagaaaaaaaaaaaccctgctttaaaaagtttaaaatccatagtgtcagtgtggtgccaaggcaggctcatcaactgtagaaaatatacccctcttggggacggggtgtatagttaatggaggaggctatacaagtgttgggacagagggaggatggaaatctctgtaccttcttctcaattttgctgtaaacctaaaactcctctaaaaaataaagtcttataaaaaagagttttggatcttatatactgttctttgggtttttctgaattataacaggaaccaatggcatcctcgggtactcccatcccccaggatcctcactgattaccacgtaaaacagtcatcctagttctgaggttttggccatgtcttcagtgacctatatgcctccaaagaaaagaccacaatttatcatgtttaaaacttgctgttccattcaaattttactttcttgctttgtcagaataaaatgttggaatgctgttagacacttagagaaagatattttcttctttgcatttatttttagaataatttattttagtagatatccaataacatccagaatatatttagtgaacttttcttaaaagctctctgtgttacaaaaatgaccatatacactttttcacaatgaaagcccattttctcatgtttaatatagcatgtaagttctatgaaataagtaatttgagaaaaataaaagctgattttataataatgaaagaataataaaggacgattattgtccataatacttcaagaagatttggctaaagagatttcccaattagatctttcatagttaattttaaaaggagtcaatgatttcaactaaattattgctcacaattttggactaacgcgtagaatgacaaatgttgacagctgagtatatgtgtagtgtttgtatatacacagtatatgaaaataagtaccatatatgtctttataaatatttttttctagatttttgaaatgagccaataaattaaatatagacctcattgtaagcatgattaaagcaaacattataagaccacttcatttgcatgcaaaatagccaaggctgaagatactcacaagaactgaaaaccatttttcatctatttttctatttcttgaataccaaattatgagacatcagaatatagtaaccaaccaatcacaacggatgctttaataatatcagaacaggtagattgcttatgttattggtaggtcaaagtcagagtttgtactgaatgttacaaatctgtacatcctcttgatcaatatttgtgccctgagactatattctaactgcaactaaggttacacaccagaaaatattttttctgcttgctagctgccccatgtatcttccaaagtgacaatggagcagaattcacttcagctttttgccagaaagctcacgatattgtggaaatctcactcgccacaaggatctacagaacctgtaaatggggatatgtgaacaagcttctaccagcctagaataggtcatcttctcttagcctgtagtccagggcaccaggaagcacagctccatggttggtggccagttcttgtttccttcgccattctccagtgtgtgccctcaataccactaaaggaatcagtgattgaccaaatcagtttctctctgctttatagccaggagaagactgaacaaggtcaagttataatcatacctgccaggaaagataactgactagtaaagaatgtacatttgtactgatttataagatacataatcaagttgtttgaagcacttttgctgtaacatttcttgatttagaactctctgtagctgttcaccacacttaggctaaaataaaagtactctttaagttgcagtatatgtaataaaatttggtagaatctctttatccttatgttattagtactagtgataaactttacagatacattttcatttcttccgggaacactttttgctccaaatatgtgctagaaaagatgtttagtatctttcagcttctaagtaatacaaggaaaaagcaacagtcacctgtcaccaaggccaaatgttatcatatacccattgtaatgctctttctgaaatatctctatctcttaatacatttagtttagggaagtaagaaccacatgaggcccctggatgacaataatcctgtcattcatgacagcatggaaaatatgattttgtggtctattgtactgcatggtaagtacagttaataataatgtatatttcaaaatcgctaaaagaataaatttttgacattctcactcctaaactatattaagttagtgagatgatgaatatgttaattagcttgattaaatctttctatgctttggttcagggccagggttcaaagcaaaacaaaaataaccatgtcctgaaaaccttagaaactaagattttactgctccttacagttttggttttgctttgcctgcaaatgaacattgagatggaaagctattaaataaccaaattcagcatttcaaaaatgtttttttaaggctgattcttcatagccacagtatcccattatacccagcaaccaattatattaattatttttgaattttggccatttgtgaaaatgtgtaaagaaaggggcaagtaaacggacagtcaaaatagtaccaccctaagagaagtcctaataactagacttgaaataacttgcctgtaataaaattccctggagtgaagaagaaaaagggccttgtacaacacattttgtatatggcaaaaggttaaattacatctctacatgacgctactcaagaaggcaacttggagtgaattaaaagttcaaatatgatgggtaaaattttttaaaagaaaatttagcagagtatgtggccttgaggtaggacaaattatttaaaaagcacaataatattgatcataaaataaaggttaataaattctacgatgtcagaattaagaaattctgttcatccaaaggtcacttaaggttaatgaaaacataaattatactgcaagaaggtatttgccacatatacaactgacagttgattattaacatgctttaaaatatttcataccaataattgagaaaaagagaaacaactgagtagaaaaatggccaaaacaatcacaacattttactaggcaggcattgcaaatacccaagaagtatctgaaaaaatgttcaaccacataagtaaacaaagaagtgcaaattaagatactaatgagataccattttatatttactgggctgttaaaaatgagacttttgatgatatcagaatttgtcaaaaatacagggcaaaatgatcctttatacatcgccgcgaaaagtataaaaagatggaaaaaattggccaggtgcagtggcttatgcctttaatcccagcacttcgggaggccgaggtgggcggatcacgaggtcaagagacagagaccatcctggccaacatggtgaaaccccatctctactaaaaacacaaaaattagctgggtgtggtggcgtgcgcctgtagtcccagctacttgggaggctgaagcaggagagacgcttgaacccaggaggcggagcttgcagtgagccgagatcacgcctctgcactccagcctggcgacagagcgagactccgactcaaaaattaaaaaaaaaaaaaaaaggaaaaattaacattgtaacataaatttgatatatgcacactcaggatacaaacattttagttcaaaatacaaaacttaaatccttatgcttgtgcaacagaagacatatacaaaagtatttatagcaacactgttagctctaaggaaaaaccaagacaaaccaaaccaaaacctggaaccaattcaaatatccattggcagaaaaatgcgtaataaactgtgccacgtcaataaaatcaaatacctagtagtgaaaataaattaccaccatttccaatgatgaggatgaatcttacaaatgtaaaacagtaaaaacaaaaaaagcaaatgctggagatataatgtatggcaccatttttgtaaaattcaaaaccaagcaatttctctctctctctctctctatatatatatatatttatgtgtatgtatgtatgtgtgtatgtatgtgtatgtgtgtgtatatacatacatatacatattcatcaatatagaattataactaccaactttatgatagtgattagctagggaaatgctggggaatgagatagtgaattatacaggtatctttaatattggtaatgttttagctctaagtctaggtaaaggattcaatagtgtttatgttattaaattatacatcatcacatatatattatgtatgtaattatataccaaaagaaattgtgttatcataagaatccttatagctgaaagaggaggaagagagtcagtgccaaaatgaggtgatgtgaaactgactgggtctctggtagaggaaaaaggccaagaaagagccaaagaatgtgggcagcctctagaagctgtaaaagcaaaggaatggattttctcctagagcctccagaaggaacacagccctgtagacaccttgaatttagtctggcaaaacacactggacctctgacctcaagaagtgtaaggtaatacatttgtgttgtttaagccacttgcagaataaatatttttaaagttttctgtatgttgtgtttttttgacatcttaaaaaatccttctggctgtgaagagactacctctccccagtgccagtcaaatttcaaagatagcaaagggcccagcctggagcatgtcttgagtaaacaaactcataacctcagaaccttcccccctctatcagccagtgcacccagaagacagtgttcctgtgccttagtcatctcagggctaggtaccaggcaactagaaaccatctctatagcccaaagcctggcaaaattattcaaacgaggcaaccttaaataaacagttcaccttgccctgcctgcctttgcagaagaaacctcaataaaggctgtggcttaaactttcatgctcctaccttctgcttcctgaccaccatgatgtctttcccacatggccctgcatgggatgctgtgcctcttgtctctaggacccgtgagtataataaactgtgttttttcctgagtctccctgtttcttctgtggccacatcagactgaccatctcataaaagaataaaaacaccactcaatttgtggcaatgtgttacagtagcaataggaaactattatatctttttgaactgatttgcatacaatattattaccagttttcgaagacatctctaaaacaatagactttcttttttttttggccggtaattggagatggtagaaaacttaaggcaaataccactggattcatagccagatggaaaaaataatccagaattctttctgttttaaaaaatcctaatcagagatcttggcaaatttcaaaatgatcagaaaataattcacctttgtcaaataatcaagaatgaagctcagacttcttaccaatgtctcactggtttagctgcataagcttttacagttctgaagtgctgtacaatataggttcccatgcgtcaggaagcacagaataccgacacccaatggtgcaataattgcttctaacatcatctctgtaatatcccccatgttgcctataccatctgctctaagaaccccgccacagggagagttgtcgtctggggccactgattctgcagtaatggcccattgggaaagtgcctttcaattctcagttactaaagcaacagggaagaaagtcattttataagaactatttagaggcttaaaaggttatcttaaatctccctctgacttctccattatccatatgtacaattattctcctagaaaaaagaagattttaaaattccaaaatttttttaaaaagcaatctaattgtgtaccagttctggaaacatgcaattaagagggattgattagaacataaaatgtgctgaatcaattaaataacactcttcatatctcatttagtaacctctgcgtaaatataagattgaaaattaaaatactagcaaaaacaatacaaagctgtattccattaagaatactacccattctgtacactcgaatgcaataatttctggagaggtaaacttagttcatgggaacactctttcagaagttgaaataaattgatttcaattaatatagctcattcagtttgtgggcacctcgatttaggtgtaaacacctacaaagggccagtactcctagtagctgcttgctgtcaatgaaaaatagtaatttttgttgctcttggattgcaaggtaacaaattaatctcccgctaaggtgctgcacagctgtgctccacaagcccccattcatccaccagccccttctgtctttgatgctcacttaatatttctattcaattctcctttgtctgctaattgtatgactaattttcagccttaaaaaaaaaaggctagataaccaggtggacttcactctgtccttcacagcaagttgtgtcaacaagcctgtgggtaggagaaaaaaatggcagaagtttctacatcatttttctgcccacttctcagctcctaaactccaatttactccattttgtgtcaaacccactaggaagaggaagctcatctacttctcctggtttagacaacatggacatggaagtctactaatacttttgctcatgacctgaaatttgcatcacaaatccactcattccaacagaatattgtctctggattgattttattgctgcttgatgttaattacacaatttacatgttaaaataaacataatcgtttacacataagacattagtttgtattttgtatatttatttatttattttttgagatggagcatggctctgtctcccaggctggaatgcagtggtgccaactctgctcatggcaacctccacctctctggttcaagcgattctcctgcctcagcctcccaagtagctggggttacaggcacctgccactgcgtccatgtaatttttggattttttagcagagatggggttccgtcatgttcgccaggctggtctggaactcctgacctcaggtgatatgcccacgtcagcctcccaaagtgttgggattccaccacgcctggcctcattttgtatatttaatatgtgggcatctgcttactattatttttggaccttcactaaacaattgttctactactggaacatatgacgtggctcctaaaacagtgaaaatctctggggaaatgaagtatcatttggtctttggaacattctattatcaatcaacactacaaatgatcttcaaatcagatttctaagaatttcttcccagtaatgggaagaaaattttttgagaaaagttggagatacttcaaaattttgaggtggataagagtgtcatagaatcataatgattttgaagacattctaactactgtgtttccttaaatgtctgatataaactgtattctattttattaatgtgtgtttttaaaatttaaaaaattgtggtcaaatatacataacatttatcatcaaagatgataaatttaaatttaaaattttaaaaatttaaaaatttaaaaaatcgtgatcaaatatacgtaacatttatcatcagagacattttatacattaacagtattatgcagtattacagtattacgcagccatcaccaccaccacctagtttcacaacatttttttcaccccacaaggaaatcctgtatccagttagtgatctcctttcctcctcctctagtctctggcaagcactcatctgcttcccgtccccatagatttacctactctggatattttaaataaatagaatcacactatacgtgaccttttgcatctggcttcttccacttagcataagtttttacaaggttttatggtacatttaagaacacagaggtcatttgtttatagaagtgtgaagggcctttttgagagaattatgtatgtaaggtgatatgtaatatgtaatagtttcagagatatatttttggaagtgagtgttctatacacaatgatgtatatgtacatgtataagccatcacaatgcctgtatatatgtattatacataaaacccatgggaatccacaatcatcataaaatatgaaaacaatagctactattaataaaatgatactaactttcaggcataaaactagatgctttaaaaataatttggaattgaagaaataataagtaaaattgccctgtatataaagtttcaggatcatactgatgcttgtaaaggcctaacagcttcatcttgcatacaagtacttttcatgatagcgacatctgacactgtcagggtttatctatttacttcacactaatcagtgttttttttaaaatatcatatgtaatttgggactaatgttatagaactaacaaagaaaaaaagatttattttgggcctgtgtaagatcaaattttaccaaaataaataatgtgaaccaagtttgtttacctcaagtgtttccagtttaaagatatctagatttttagttatacacacacatatttaaaaatttcatctatttaaaggttcacacttcccttcacagttttattaaactattaacacgtagtagcttggcatttgataaaagatatggtttagtaaataagaacaaaggaatagacattattggcaaaaactttgttgtatttgacatttgtcctcagtaagaaaactgaacataaatataattattccaataattattttcaaatttttctgaatgctaaggcttttttttgtggttttttgttgttgttgttgttgagacagtctctctctgtcgcccaggctggagtgcagtggcacaatcttagctcactgtgacctctgccacctgggttcaagcaattttggtgcctcagctctaagaagccaggattataggtgcccaccaccatgtctggagaaattttgtatttttagtagagacggggtttctccaagttggccagactggtctcgaactcctgacctcatcagatccgcacgcctcgatctcccaaagtgctgggattacaggcgtgagccacggtgcccagccaatgctcatgcttgttatcacagttttacattttaactgatatttaaattttcagaaatttaaaccacttattttctttgggaatttttttaattcatgaggacttttatggcatacaactaactatgaaatgtgagaggttaaaaattaaaggaaaaatgttccactttggaagaattttagttaatgaaatattatgtcaaagaaaaaaaataaattgcatttgttttctttctgagcaattcagataattcttacatagttgtttattgatttggagattggccaaggaactctgtggaggttaagtgtactgtaaagctggagaggaattaacttcttttagaaactatcattgaatattgctgcctcatttaggacagctcttgacagtaacagatgaaatgtttgcttcttctgcaacaaataaaattttaaagtccacaattcactcttaactgaataagacatatataacctattaaaatcagaattaaaagaaaaatgtaatcaatcattagatattttctacttgggtagagaacaccactcattttaatatttctacatttacaggtatttgggtttatgcatacatatataaaggtatttgaatgtagggtatcacaggcaaaagataggttgcaaaattttggtgtgttcttgcattgcatacaaatatttggcaacctgtgagtattaccttctatttgagcatgtaaacttgaggaaattcatattttgttgaatgtaaatcctagtgtaggtttagcataatgttgcagctgaaacttttagaaatacttaagtatgattatttcatttccacattatagttttgatctgttcggaatcgattgatatttcttttctctgtaaaattagcttgctatttatactcgaatactttcatgacaaaaaaattatttgaagtgatgagaacacatgtactaaattaagcatctttaccagtggtgtattgtaggacaagaacaacaactgagatctcactgcttttcattcaggccttttgctatcaaaataactcagcatgccacataatatactgcttaccacaagtgacaccatctcataggcaaggtctcttttatggtggcagattattttctctcagggactatgcccatataccagctgaattccactgagcaacttctgttcaaaccatgtagaaaaggctcagtaaagccctgctcagatctctggcttacaaaatcatggcatgtaatgaaatgtttgttttgtataaaccacaaagttttgggatagtttgctatgcagcaacaactggaatagaactaggaaactagaagtgggtgctgctctaagaagaaaacttaaaacatgttcccttgactctgggagcaggtagcaagaagtaggttgcaaggatttgaagagattgttgtgatggttaaaggaatgagaaggaaattcttattagaggagagaaaagaaaatccacccctacattgtggggcagaaagcttgacaactcatttcagtaatgtagaaaacagaatatgcaactaatgaactgttgcatttggccaagaatattttctggtaaattcctgaaaaattccacttcacttttttgtgggctctgggtaaagatcttctcaaggatgtgactacgaccccttgcctatacttcagaaatattaaaaatgtgcctcataaatgttctcaattagattaaaaagtttctaagaatcataagagcattatctcaaagaatcttgattcccaacccaaggtagagaatcataggaagcccacaaaaatgttaagagaattagactagtagaagcaccattggcttcatttgaaatgggcagggacagttcaaaatgcaaagagcttgcaaggttcccacatttctatgagcaggaagcggtatgaaaaggctactttgtagcaaacatggctcatttttaccgaaaaggaaagatgactcagaaggcagaaacaagagccaacacggtaaagtcaagatccacattttctgggagcaggactgggccttaataatgtaactggaaggatatgctttcccaggctccagaattgctatgaaccagtgactacaatgtacttcccatcaccctttccctattgaatgggaacaccttatccctattgcagttttcctattctgtatcgcctctgtaggctgactttgtgtgggatagaaaacctgttcttaaattcacaggtcttttgatcgagaggaatcataagatccaccttttgggaacctcatttgcactcgcatctaatttagttgacacaattccagacttcaaaacaatgctatagtgggacaaaaaagctggggtctttaggaaggggtgtttatgttttgcatattggaagaatgtaaacaatgtcactagaaggccgactgtgtcagattaaagatgtcctatgggttgtaagaatcctcaaagcttttaccctgtctcttgaagcgctctgagacacagctggctgccatgtcagaagttagaaaccccagagaaactacactgaaggagccacatgtaagaactctggtcaacagtcccagctgggtccagatttccaggcttcctcaccaagacactaggcatatgaatgaaaccattttgaatgctgatcctccagctgaaaccagagattttatatcaatgacaagaggagcagaaaagttacccagcaaatccctgcctatattcctgatccacatacatgtgagacctaataaaattggtgttgttttaagccattttattgttgatgttcctgctttaatttgttttaaaattcagatagagcttacatacagatctgtaccaaatgcatagagatgtgtaatcaccatcacaggcaggttacagaatagagctctcacccacagatattccctgtgttgcccttttgtcttgaaaccatccctacacctattccctcaaagccagtgatgccttcttcatcctcattgttttgccttttctagaatgttgtataaatggaatcacacaatatttaacattttgagtctggctctttcttgacttaagttattgtgtgtatcagtttattcctcctaattgctgagttgcattcaattgtacgggcgtgccacagggcttattcacccattgatggacttctggtgtttttccagtattttgtgattatggataatgctgatgtatacacttgtgtatgggattttatgtaagcatacgtgtttgtttctcgtaagtaaatatctacgagtgagattactgggtcatattaagtgcatgtttacatttagaaaaaaagtgctaaactgttttctagaatggctgtactatttgcacttccgtcaattatatatgagagttacagtttctttgcactcttatcagtaattagtaaattcagatttgtttaaaaaattaatttcaccttttctaatatgtgtgtagttgttctcattgtggttttaatttgcattttgctaatggctaatgatgtcaagtagtgttttctacctatttgcaatgcgtatatctttttagtgaagtgtaacaaacatttaaattgctcattaaaagtattgtttttattttactattaagtttctagagttctttataactattctggatacatatcctttgccagacatgagattggcaaacttgttttttcacagcatgtagcttttttttccttctattaacagcatttttcacagaaataaaggtgtttaattatgataaagatccctttatccattatttatattttttaaattgtgcttttggtgttatatctaagagctcgttacctaacccaaagtcacaaagattttctatgtttttgttttcttctaatcattttataattttaaatttcatatttaggtttgcggtcaactacgagttaatttttgtatgaggtatgagtacgtattgcagcttatttttttcttctgcatagttgacaaattattccaacactatttgttgaaaagattagaatgctattttcttatggtgcagaacctaggaagagcagatttaaaactgtgtgaggcaagaggttatttgttcacacctgagttttgctcatctttgaatccaaatatataaaatgttttttcttttgctcagacacacagaataattggcattagctagaaattccctagcatggtttttgtgagagtaatgattaaaaaacaacaaaaaagtcaggtatgacaaaacacaatatatcacagcaattttgttgttaaaagaaagtaattttaaaaataatagttaaaattttaagaaatcttatttgttagaaagctgacaagctaaaattgaatctgtagttcaatatttaacatcagtagaagctgtgtgaatggatattgaccaaggactcacctaattaagttgagggtaagaaaatatattattcgaggtttttaataagctattttaagaaacataatttgaagagtaggaacactaaagcttgctttgagtattgttcagaatgaaatagttgtataacatattctgcaataactctggtactaaaattgtcaagagcaagcaatttagtcttaatataagtaataagaaagagaaactccagaaaggaaagagaattgcaaaaatatgttgcattctgaatcaaatagccactgggcttttacagggcaagacactgctaaactcatggggaaatttaaggaggaaaaatctctctctcctttgtttctgatgtttgctttttcttcagtgttttgagagtaaaaagaagatagatggaaattcagacttgcaatatgtgccattagaaaattacaaagcccttatgatctcagcagaaaaatgatagcttttaaagcctgttccctggtgcttcatcacctttcccagaaggatataaattactggaagataattgctatgaatacatcattctttttcttgagattccctggtccttgtgaaactcaatctatgtccctaggagcagagttggtggagaaggatgataccatagaagagagaggcaaaattattgaagatccattctgttggcttgttttgttttactttaccctccccatttaaaagaatcaagaaaggacaacctatttgattatataaaactctgtatctgttgtggaatatccatagctgttgtgggataaaaattatttcaaaaggaaattcagaattaagctatttcctctcttttaaatttagtcttacagaaaagttgcagaaaataagagtttctgtaaaccttttatacagcttctgctaatgttaatattttacatattcatagtagtttttgaaacctaaaaattaacattgatacaataccattaacttacctgcagacctattttgaatttcacgagattatgaaaaaagaattcaagattataaaattaaagaatctaatatcctctaatatccctttttttctcgtgtaggatctaatctaggatcccacattgcatttagcttttaacttagtctcttctaatctgtgacagccccatagtcttttttttcttttttcatttttttctgtctttcatatccttaacactttttgagatataccagccagttattttgttgaatgtccctcagtttgggtttgtctgatgttttctcataattagattggtattagtcctttttaacaaaaatgctgcagaaaggatactgtgcccttctcattgcatcattccaatagcacatgatgtagacctgtttcatgggtgatgtttagcttggtcacttgattaaagaagtacctgccaggatgattcatggtaaagatatagtgaagcttatttggtactatttgcatgatattttaggtttccttataacccttgcatcttggtggatttcaacaattcttatagatatttagtgcatttttgaaacattttgtaatttctaaagttgagatattacatacaataggtgttcaaattgaaaaaaaacacaaataatgtatcttagaagtgacagctctgtgcctgggtttatgagtacagaacaggaccccctctcttgatccatacaccactgcagctgcagctgttgctgctgccattgtaggctgggacaggcaagccagagggctgccggtctgtggctgtgagtggtgactatgtccccactagtagcatggcctttgtgcttgggctcacaagggaaggagagggttcttcccctactctgtatggtgctgtggtgctgcagccatcaaaagtagttaggcctgagagctatgtgtctggggctatggttggcaacccagcattgcagccactggcaacaccaccgtgcggtgcttgggacccagagggttgtagtgccactgccactgccattgcccacaccacactggctgctcagggacctaagaacgcaatcacctacgtggcctgtgactgccattactggcatcagagcaagccacttggaggaccaagaagaggcctgcctggtcctactgacacaggtgctggtgtatgctgccctgggagccgaagaacaggcacattcgaaaccctgctacccccactgggaccaggacctaaagactggcccacctggcgtccctgcccccagcaaaatttaaccataccctccactagttcctgtaccctaaaccactgaggaaatcacaaataccaccaatgctgtttatagtcaagtaaatcatacaaagattgcacgactgcatgcacccagaatcaaagccaaagggttctaaccaattgaaaccattgatacatattcaggaaaaagtcattccttgtgaattcaaagaattgtaagaaatgactattacaccagttacatatatatcaacataaggacaccagaaacatgataaagcaaagaaatatgacgccttcaagggaacacaataattccttagcaacagatcccaactgcaaagaaattaacaaaattatgaaaaaggaattcaaaattatgatattaaaaaagcttagtgagataaagagactttgaaaatacaatacacagaaatcagaaaaacaattcaggatatgaatgagaaatttacaaaagggatagctatcttagtgaagaaccaaacacaaattctgtaactgaagaactccccgaataaaatgcaaaatacactcaaaagcttcaacaatagactgaatctaacagaagaaagaaccacagaacttgaagacaggtcttttgaaataactcagggaaaaataaagaaaaaagaatgaacaaaatctttatgatatgtgggatagcataaagcaaccaaacatacaaattattggtattcctgaaggtgaagaaatgttaaaagggtttgaaagcctatttaatgaaataatagatgaatacttcccaagtctagcaggatatttagacatccatatacaggaggcccagtgtcccccaaagagatacaatgcaaaatggtctccgtgacactttataggcacactgtctgaagtcaatggcaaaggagaattctaaaaacagcaagagaaaagcatctagtcacccctaaagtagttaccgtcagactaacagtaagcacttactatgtattttcacagttttaggtcgtacatttaagtatacttactatgtattttcatagttttgggtctaacacttaagacccatttaagtgctgacttttccctataaaaaggacattggtcttggcaaagattttatggctaaaacctcaaaagcataggcacaaaaataaaaatagacaaatgagaccatattaaactaaaaagcccctacaaagcaaaataaacagtcaacaaaatgaggagataagctgcagaatgggagaaaatatttgcaagttactcatctgacaggtgactaatatttggaccatataaggaacttgaacaactcaataggaaaaaaaaaaaaagttccaaataatcccattaaaagatgggcaaaaaacatgagtatacatttctcgaaagaagacacagaagtggccaacacatatcttaaaaagtgctcaacatcactatcattaaggaaattcaaataaaaaacacaattagatattatcttatgccagttagaatggctattattaataagaaaaaataacagatgctggtgaggacgcagagaaaagagaactcatacactcttggcaggaatgtaaattagtacaaccactatgggaaacagaatggagatttctcagaaaactaaaagtagaactaccacacaatccagcaatcttactactgggtatctatccaaaggaaaataattcagtatatcaaggggatacctgcacttgtacgtttatcacagcactattcgcagtagcaaagatatggaataaacctaactgtctattaacaggtgaatgagtaaagaaaatgtgtcatatatacaccatgggatactgttcagcctaaaaaaagtttgaaataatttcattctcagcaacatggaaagagctgcaggtcattcttttaagtgaaataagtcaggtatggaaagacaaatattgcaccttcacactcatatgtgggagctaaaaaaactcatcacttcacggacatagagaatagaatgatagataccagggactggggagaccgggtagtgggaagagagggattaagagaggttggttatggttataaatatacaattagatagaagaaataaattctagagtttgatagaggacgagaatggctatacttagcaacaatatcatgtatatttcacagtaactggaagagttaccaatatagttaccagttaccaacacaattcctgagtcaccaataccaatatctgccaccaatatttctgataccaatacataaaaatggtaaacccatgtgaaaatgatgtatgccccaggtacgctgacttgaacactacacattctatgcatgaaacaaatactcacatgtacccaataaatatgtaaatcattatattaggttggtgcaaaagtaattgtcattacttttaatggtgaaaaccgcaattatttttgcaccaacctaatatatcaacaaaagagggaaaaatagtgacagaatcttagattgacatgtactcacaggaagaatgaagtcttacaattaaagaatatgggcttgtctgtgttacactcagaatttgtttgtttacataattataatcaaactacatatattatggatccttctattattggtcaccaattattctggcttctgcctttgtggctctttccttgaagaagaattatatatccctgctttgctgtactcaggagtggccatgtgacctaagaggtgaatatcaaagagttagacaacgaggacataagggcagtggtggaaagagtagtcgatgaaggaacagcaaatgcaaggaacagatgtgagataaaatattgctactctaaaaagtaagagttcaaagggcattctgaaatgcacagtgggttaggagatggggtggggcgagaattcagtctgatgacttaaggtgagacagattatacagggctagtataagccatggaaatttgaattttgctccaacaggaattatttgagagccaatgaaagagcagaaaaatgacaagatcttatttgagttttagaaagatccagggtagtgattgggtgggtagtaagggaggagcagagttagattctgtgacggttcctgtcacaacagtgagaggtgatccccaaagtggtgaaaaagtgacatatctgggaaatatttgcggggtagaattgctgtgcctttgtgattcattagatattgagcttaaggcaggaagaaataggtcctcaattttctggctgactcaatgagatagcaaacaggtgaagcagatttggatatgatgagctccaggaatttgtacaattgagggagataatcagttcagatatttgagaaaccaacttactgattagactactgtgtcagtgtacagttaatcttgcctttaacattatagcatatatatatgctgttccaataacattatagcatatatatatgctgttccaaatactatgttttaatgttattttggtttgttttatacttccccatgcctttcacatggagacacttgggctatagctattgactggacaattaccactatacatgtggatggccataaagccaaggacaaggataaatgtacatacagagcatatgtgtagcaaaggcagtgcctctgattgaaccttaataatggctggcattcaagaaatagaaagaagataatagtgcaaatagatttgggaaggagtggccagagagtcagaaaaccagagatggttgaattagaaaagccaaagtaagacagttttcaagagcataatcaacagtggcagattctgcaaagatgtcaagaaagtttaagcttaagtggttcattgttgttattgaatactttggaaatagcaattttagtgaagcgattggtgaaaaaccaggaattgaggaatagcatcaggtacaaccatttaaagtaatttggctgtgaatagaaagagaaatatgggaataactagaaataaacaaatccagggaaagctttcattttaggagggcagttagcaaatcaaaacattaaagggagaagacacataaagaagagttgaaatacattgagtgtggtcctggagtaaaaaggacttcaggatttgatgtagaaaaaattgggaactaatcttatataaaaggagggaaatatgcctcaatgtatcagcaggaacattatacccaggttaaattttaggtttggtggcaggttgctaaaaggtttcttgtgttccggtctctacgttttctgtgaagacaaaggtaaggtcatctgttgagaatcagaagacaggtttggaggttaagggtaggtttgtgtgaaagactagcactcaccctccatttgacctgtcttgtaacctgtcagctagtattgcagaaattagaaagatagaaagatattaaagctagggaccttgatgtgatttctgtttagtcaattacatgcacttgtgggagattgagacaaagccatgatctgctcattctgagtttctacttgcaagtggatttatgggattatagtatcattgagtttttccacagtagtgtcaatggagattccctgtcatgtcactagtttcatgattgttgaaagaacaaataaatgtaaattatctagtaataattataattgcggctcagtgactgctattgtttctcgattcgtagatttcagcagtgtgttcctggagccaactgttccagtagcagccttcccacttcctgattcaggcaagggtagcagctttgcttacaagccaaatctgtggtataatcctcctcccccagctttccagtacttttataaacatctgattcccagaaataaattcctttctgtgaggtggctggcatggtttctgttacaaccactgaatgcaactggagcaatctttgccatcagaggagttgtgggaataggcactttgtactgttcagttggcctatttgtgtttgaaggccaggcatatctgaatccattaaatgataggatactagaagtacacagaaaccagtggcaaaatcagttaaattttttacctatggccacctgaattgaagtacatgattttgcaaaccaagtattgaaagccatagcaaagaataatgtcacaggcatgagggagtcagggactgagaaatgggttgcctgcttctgattgcattggggagctaaaagaaaaaataaaatctggtgcagaaaattaaattctcatattaaggcatggtcagagaaccagggatttttcatgactctcctgaatgtgtatcttatctcttgtaccttcatggatgaagatggtagggctgaaaactaaacacaaaggattaatctgtggactactaaactaaaaggtacattatattcactctcttgcagagtgacatatatgagtgttagctccttggttgggaaagagtaaaagttcaaatattagaaaaataaaattgggaagatttagaaaattctaacaaaatctaaggctcttgtgttagcagaagcagctcctcctcccatgtatgatgaaggaggggtatacctatttttcttatatcccacctcaaccttccatcactgccctcatggagtagatctctgaaagcagctagaaagccaattatactcaatccaaggaagagaagttttgtatcctaaggaagtgctagattttaccattttttgtgcataaattgttatatgtggaatagattctgagagtgctagaccatggattatgaaacaaaattttagaattggctaaactgattgctataggtgtgtttacagagattctagatgctgtgtattagctcagatagccaggaatggctcctatgggttatttggctgactgaaagctgggcctagcaggggactatgctgaatgatgtttatatattacaaatttcttagtctgtcatatatgagacatccaaagacatagaaaataagagacatagaaacggatttaatatgtatcctcatttaattctcttttcccagctatgtaccctaagagggcccatttaccaagggattaagattatattagtaaatgaaaggccagcatctttaaaaaaaaatgcattgtgatggctgtcctctgtaagctgaacatattgctcctgaaatgagctcccagatttcaatagtgataattgccaaggtgacagataaaaacttagcagtacttaatccaagtagcaaaatggatcctgttatcataaatggagcagctttggagtggtattcataacatgtaaaccttagtgatctttgactgcagatggttgctcaggaggttaatagacttgaaataaatgggtagctcattaaggaagatcccacttgttttgaataatcaaaataacactgggaaataaagggcccaggacatctctaggctggaagctttactgatagatgaattaatgatcttcaaattcttaggggaagttttcagacaaaacttaagaatgtctcatgaagaacttttacatagggatctatctaggacagtttcaaaacaaagtttacccttatatcagctaacccagaaaaaagagaagcctgtctgtctgtctatctatctatctatctatctatctatctatctatctatctatcaatcatctatctacctacctaccttcctgctacctacctatctatctacattttttagtaagtcacacctttatagaagctttttctggttaaagcatgatagaaacatcataagtgtggtgtaaatttcacaaagaatttgttgccatcgaaggagacatcaagaatgaactccatgtaaatattttgagaacaattttatcaaataatgaaagacaggatgcaacaatcattttatgagtgaaataaatagataaatataatcacagcagaaaaagaaagtaatatggcccttgcatcagatgtggaagataaatgtgaaacaagtctgaatgtatttataattagtacacgtgtttgtgtgcaggcacacaaagaaagtttaaaaaataacatcaaagaataaattcatacaaaaataaaagagaatatagtttgatctccagtttataagtattactaattttgcaaataggtaggggcataatcatgaatcccttcctcgtcagaatacccagtgctcttcccattatatgacagcattgctgttacgtagcccactgagtaatgagtacagaaatattactcttgggcaagtttactcattagtatccttataaatatacactttagagcacacattattttcaaagaggacagtatggttcctgagggagcaaaaattggttcttggtgggtgaaagaatgcttaccctttttatgtataattcagagatatgtacagagcatataaataaatttacagttcatctgaagtactaaaatttcacggggagggcaattagggaaaagatgtctaaaaagtgtctttagggaggcataatgaaaaaaagtgttgagaaacactgctttaggagaaactaaacagaaaagggatgcaaagcatagtcatttctttttatgtctgctgtcaaattttgattaatcatcttaatcttatagtgcatggatgaggaatagcaattatctttatagctagttataatatgaaaagaagtaaagtatatttagaatcagaatttttagcctttttagtagctgcttcttgagatgcatatataacaagcatacgatgtagggtatattagcacagtgagtgatcattgaaagacggagtgagcagaaaaacacaagagaagctgatgcaatgtatgaaatgatgctcatagggagaaacagtgaaataacaacctgaagcaaacaaagtgacttccatcagggaaagaggttaaatttcatctcataagctcaaagaggcacctggctattctcttattacctctggtagaaagtcttgtgccagttccgaggcttcctgagagactggaagtgaaacaatgtcacagcttagcatcattaaggagtggaggcaactccattggagagagagagaatgagagaaaggggtgggtatgagtccttataggaaaaggtagagagtaattcttcactattccgaaagtttgacgatagaaaagagtcccagaagcgctggaagacttaatggagaaggaagcactcccaaatgtcttccttaccgtaggaggaaattaatacttcattaatatccatagtaaagtgaatgggttttgcgggtgaaggttgcccaggatttatcagtgaatattttcagtttatcttcttaatgttaatatatgttataagctcatttttgttaattatacctcttaatataatcttgtgacaagattatttgtcttatgctttatctagcctctggagtgttggcaatattccaagaaactactaaaatttttgaaaagatgctgcagattatagtactacctttgtgacagtaaatccatgtttcttcatgttctccatagaacaaatggcttatgttatcaagcctccttgatgagattgagaataacttcccttttgttttaaaaccaaatttttaagaactaaattcattttgatatacatatgtcattgttgagaaggaatctttcagtttctcattgacttcctaagtaacaaggaaggcttaactcttgcgtgcatctgttctacttgacaggacacttgtggcacagccccaggttcttgtcagtctggcatgtttgaatccttctgaagcatttagttggcttgttgttttgtgggtaacctggaagtctcatcgcagcaacagaaatatgccgtttgaacggtccagagagctacagtgttaatattaactcacacatctgtcagagattcagcctaagagctgaagagctatctgcaatttaaattgattgccaagaacttaacactaattgacatgctagattcataactaagtaacacattatgactagtgccagtcatcttagagaacacaattcccaatcttgctgcccattttatctttagaggctgaaatgacattttggagaggattctttcagaaaatcaaattctcttagaaaaatgtgatgatgatgaatataatgaagaggaatagcattgctgtgatctgttcatgataatctgatcatttctatgttatgagaggtggccaagagaagtgtttaattgatctctacgataccttcctctagagagatccttgaccaggtaatggtcattttccattgcaaattaagaggaggcagaaaagagaagagttgaatttgacacatatctttgccattacatttaactctacaatctttatttctctttcccagcccaaatatttcaaatgccttaaaaatgcaatttttaaatttacttgtcgaaaggaaactctacaatgatatacagtctgataaaggagatagcttatagaggtctgtgcctgacgactctctctcaggatacagattttttttttccgttgtcattagcaccagtttctccttgacatttccctccacagaactggaaatgtgccttttaacattgttttaacaacattatagcactaataaacaattgtattctctatgatattctgtatgagatttttacctttgtgaacaggatctgtagacagtccctttctgagcatgatgattataaggatgacttggtggatgaattcattaagcagagatttattcatatgcctcatggggtcaccaaagtgtataacattcatgcatacttatcttttgcaagcatccccataaataagcccatttctgattgatgcttatatgtgatagatcagagcacaatcattctgccaatcactggttactcatgcatggaattaaaaatcttccagatccatgccatttctatatttggtttggctttacctattactcaaagtaagaaaaaaaagagaaggaggataagatgtaaacagatataattttaacattaaaaggatagcaggatactttcaggctgttccaaaagaactgaaatagcatcaatctaataatatcctacatgaacattgttgaatttataaatatgaatgacatcggaatagccactgaatgctattatggtacttacaaatagtgaataaatgtacctttgtaagaatttaacccattggcattagataaaaaggaccaatggcacattttaggggaagtttacaaaagaacagaaaaaaatggacttttcttcaaattacacacattttatttcagttgtgataaaaattactgtaaaacctagcctgtttatgaaatagttgcaccctaatatttttgatttttgaaaattattcttggatcactatataaataggagctctaatttcttatcatggagaactctccataaaaatttcagcatttttcacaaaattatctttctataaacatgcgtgaaagagcaaatgcttttagaagaaagattatagaattacactgaaagatttgaataaaaaagccaagttcattaaggctatattatccaacattaacttgattgtacaattagctgcttaattcatattttagagactgtagcattgatttatgacaatgatcaggactcagaattcagaaacagatcatattgcaaagcagtaaaaatagcagtttatccacttgtgtcaagaacacataatgaagttctctttttggaaaaaaatagtcttttttggccagaataaatacatgcttacatatatttgacaatataaacttaagagctactttatgctgagcatgtcgctagctgttaatgatacaatgatgagcaaatcacagagaactgctgccctatggacactgcattacaaaattttaaataaatattcatggctttaaacaaaatattaaaaaaagaaaaaggatacttaaaagtaaattggatgaaataatagtatgtcattgaagtatgacaaattagcataaggagaaaaggcaattccaacaaagccaaataaagtagcacaggaaaatatcatcatagactgtgaataaattgcctttatgtaagtcattaaattgttttcagtgaaggaatctaaaatggattgatatgaattataagttatttgggatgtttatgaatttccaataagttatttaccagaggcaattcttaaatatagaagtataagagatagaaacacagaaatataaagagatattatagaaactctgacagagagattaagatatagagaaagcaatcagaatatacagtatagtaatttctgcagaaagaacaaatgaagagacaaaaacgaactattattattcatagaagataaacattaattataaattcagaaagcagcaaaaatatctatcagaacgaataaaaatacacccatatataaactaatttaaaaaatgagtgaaaaccaaattacccgtaagaataataaaattggaaacattacaaagacttctcatcttgcaagataagatgtggtaagtgtatgtaaataatttgacaaggaaaggaaaaattcattgaaaaacaaaactattacaaaactgatgctatgaaaaaccgaatagttttatatctaaggaatggaacttggaacttaaaacctttacacaaataaaatgactggcttggatggcattactggtgaattttaataaacactcatggaagaaataacagttcatcaattttacatgaaccattttaaagagtagaagaaaaaggaacactttcaacatagttttaggaaaccagcataatactgataccacacgccactcttgacattgtaagaaaataatagttcaacatccaaagttaacacagtagcaaatatcctaaaccaaatattagaaatttaaatctagcaatatataaaaagaataataaattatggtcaaatgagatttatacaaggaacgcaagaaggatttactacttggaaataaatcaatataattaataatattaacagagtgaaggagaaaaacataatcatttaaatgaatgttcagacagcattgaataaaattgaattccttttcataataaaacatctcagcaaacaacagtggaagtaaactcaatctaataaggaggatttatgggaaacctacagttaatgccattcttttttttctttttttttttttgagacagagtctcgctcttttgcccaggctggagtgcagtggcgcgatctcagctcactgcaagctccgcctcccgggttcacgccattctcctgcctcagcctcccgagtagctggaactacaggcacccgtcacctcccctggctaatattttgtattttttttagtagagacggggtttccccatgttagccaggatggtctcgtctcctgacctcgtgatccacccgccacggcctcccaaagtgccgggattacaggcgtgagcccccgcgcccggccaaatgccattcttaattgtgaaatgctgtgcgcttttcaactgatgtcaaacaacaaaaagacaaaggtagccattctccattgttatttagcattgtacaggagttctgaaccagtgcaataaggtaagagggattggaaaggaaaaagtacaactgtcttaacagtttgcattaacatattcatagaaaatacaaaaaattggaaaagtactagaactattgaattaagttatcaagttgagaatatgtcaatattgcaaaatttattgtttgcccatatattaattagaaacaattggtaaataaaatttaaaatacaacatttacacacacacacacacacacacacacttccaagctctgtctgctgtgaagcctagacgcaatgaaacctctgtagcaatgaacacatctggtgatcagatctgggtttctactaccattctccaattaaaagaaaaagaattcttgcagaaatgactgatctatggttggggtgggaaaaatacaagatgagtctggaacatcttatatttacagaacacaaatgctcaaaaaccaaagtggtaggaatgtgtcagagacacagaagctaagggaataaactcccagtggccaaactgaacaatttgagcagcaaattaaataacatagcttagaattttaactcaaagcataaaataaatgtgcaagagtctatattgatatgaataaattattgtataaataaaaaatgggaaggaataaatctctatcaaagaatctcaaataatatgcagaaatggttccctcaggtaggtggaacataatctctttatccccttaagttgggctacatgcagtgacttactttcaaagagtgctgatacagtttggatatttgccccttccaaatctcgtgttgaaatttgatccccagtgttgcaggtggggcctggtgggagatgtttgggtcacgggggtggatccctcatgaatggctttgtgctgtccccatggtaaccaatgagttgtcactatataagttcccgcaagaactgcttgttaaaaagagtctggcacctttccctctctcttttcctgtactctcgtcctgtaatctcctcatgctggctcctgttcccttcctacttctgccatgagtggaagtagatgctggtgccatgcttcttgaacagcctacagaactatgggccaaaaaactgttttctttataaattacccagcctgaggtattcctttatagcaatgcaaaacagactatgacaagaacagcacagtgaaggttaaaaaaaggagttactttacaatggaaaaatcagacagataccacctcagggctgtaatcaagcttaacatattcaataataagtcatattgatagtatatactcttgataaaaagtaatgagagtggtactttacttctgtgggcttccttccaaaaatctcataatctaatctattcataagaaaaatatctatgaacccaattgagagacattctacaaaatacctgactaatactcaggttgaggttataaaaataatgtaaaaaattttcacaatctagaggatcctgtggaaacatggcaactaaatataatgtagtatcctggataggataacgggacagaaaaataacattagtaaaaactaaagaaatccaaaaagcacagaccttaattaataataatgcatcaatatttgttcacaaatgttaacaaatatatcatcctaactaatgtaacatggtaataatagaggaaactgggcatgggatctaggaaaattctctgtactgcctttgcaaatttcttgtagacctaaactattctaaaataaaaaggttatttttaaaatataacatgtacaagcatgcatccatacttaggaataaactaagagatatgacaacccctgaaaaacatagttctgagtaactgagtaactgaagaaggcaaataaattgatatactatgttcatggattagagcacttaatacctattttatgtttgttttgtatttaatgcttttcatattcttcagaaagtatggtagagagaactttgaattttgataaaggatatttatagcaaactcaagcaaacaccatatttattttggaaacattagaaatattctctttaaagccaggaataaactcaatttcatttaacattgcttttgttgaaacatcaagacaagaaaaagtggcagagtgtgtaagtactgacaggaagaaattaacatgttactattcctaggtggtgtaattatatgaagaaattataaagcatgaggactaaaatgagagtattttgggcaatgtaaaaaataatcatgttcttatgtattgacaatgaagtgttaaaaaataactaaaaggttataattttaaaagcctattttaataatgaagtataaataattaaatctaaaagatatgcaagaatttatgaggcatatgcctttgttaaatgatattaataatatttaaataaagagagtgatgcatcgtattcatggacagaaagactcagtagtttgagatgacagtttccccagtgctcatctttatattcaactcaagtttattttgtggaatttgacaagataattctaaactttatgaaaagccaattcccaagaatactaattaatactttaaacagaatttttaaactgtgtgtttggtaagttgtcctattaaatatcaagtctaatataaactgtactaaacaagacaacgtgatatcagtgcaggcatagacaaatagatcattagcatagaacttgaaaccgacccattaaatttcattacaaattattggaagtaattattcaattgtgaaatgaaaataaatgcctaccttacaaattacatgtacgtatacatatacaactgtacaaaactccaaggggactaaaacctaaacaagaaagcaaaactcttttatcagatagtataagaaaatatctttatgcacttgggtgagagaagaatttcttatggcaaagaagcatagagtattaagcaaacaaggttaaattttgtgaattaaaattatttatacatcaaaaagaatgccttgaagagtagaataaatgtttaaaatgcatatagctgacaaagtattcatcttcagaatattgtgtgtgtatgtgttaattgtgtgtgtataataaaaacaagcaaccttaaatggagaaaatatattaagaagcattttgcataaagaacatctgaatcatttattaaaatgcttaacctcactgtttatcaaggaagtacatgataagcaggaattaagtccaactttacaaccattatgtaagttaaaaaattagaagtgggtaaatactaagtgttggagaacatgtaaaacaataggaaatctcataaaattgctaataggtgcttcaaacagaatgaccacattggagagcaatttagtaatttgaatggggagcaatttagtaatttccaagtaattaccaagttatctcactcctaggaatataccctgtagaatagcttgcatatatatactatattagaaggtaatacacaatgattttttttttttgagagggagtctggctctgtagcctaggctggagtgcagtggcaccatttcagctggctgcaaactccgcctcctgggttcaagcaattctcctgcctcagcctcccgagtagccggaattaccggctcctgccaccctgccggctaattcttgtttttttagtagagatggggtttcaccatgttggccaggctggtcttgaactcctgacctcaggtgatccgccctatgcaatgattttcaatgcagagatgatctgtagtattgaaaacattagaaacaacctacatgtctagcaaagtagaatggataaatatattatgaaatactgaaatgaaaatgaaaaaaaccttgtctacatatacaagcatggagtatctcaaaaaaaacataaatttatacctgaaaaatgaagccaaactaagctacatgtgtatacttcaatatggtcattttgattatattttcatacatacagaatgaacatttatatcttaatatcaaactcaggaataaagcttaccttaagaaaggaagtttcatgtatttgtactgtttaatttcttaagatggtgatagttttttttagtgttacttataatccatgcatcttggtatgcctgtaacttttttttaataaaaaatacttcaaaaagaatgtctagtagtttaaagattcccttaacatatatatagatatatggagagatagatagataatatcattttttatgctgtattggcttaggtatctctcgagaatctaacgactcaataatttaaagtagcatttatatataagtgcttactgttgcaagtaaaatgtgagcctatcatttgtatgaaaattgaaaaactgtaggtttggacacttctgtgagatcacactggaccctcagatccttccttccaatgtgccatgcatctatgtacaccgacacctgaaaaactattaacccaaaatgtctcatcttttttgttctcattttataaaaatggtttattttatgggcactggtgaaaagtaatggttcaatgtataaatattgatttaaatcacatagcagcacaattctctaactttctaacatatgtgtaacaagatggagagtcatctgttttttgaagatagataaaaccaatatgttcatttaaaaatactgtactactgtatatacatgcccaaactactatggagactgtgaggggtaggatttaaaaggggtataagcaggctctgggatgctacttttgacttgagtgtggttacatgaatgtgtgcactttgtattaattcactgtacttcactcctataatttgtgcacttttttgcatatgtattgaataaaaagttaggaaaaggaggctcattattttatctttataatggaaaaaagtttatgattcagtaataagtaaagaagtgatttgtcagaataaaatgattacatcatcctttgtgcttagcaaaatgtttggttcattatatgctcccacaaaaagattcactgaatgaatgaatgcataaaccatgtaaaaaatatgtgcagtcaaaacatttagaagtaaatataaatgtagctaactgctaatagtgctgggtttgtgtgggggcgttatgggtggttgttttctctctttttcaaattttaaaataaataatggacttttaatgtcatcgtgggtgtagccagtcccataaggtgcttctatgatggaaatttctttcttgcttctgtcatagttatgcttcatagtgtgtgtatatatatacatatttctattttggagtttttcttaaaagtttgacagttagctgagaacatctggaccacctatagccagcccccatccccagatcagatcaaatggaattcccttttacctatatcatggaagctgcttatcatctcagtgatttttttcttcaagattattcatttttggttcttataactaggtattttaagtactggaaggcatagggttagagaaatcacatattaatgctgtagacattcatagtcctgcagactttttctgatgaaaaataaaagctttcatttaaagctttttgtctaacttctaacgttctcacctgtgatcaccaaatagatatgctctgcctgacacacttggcgtgttaaattttaaatttgtgaaggtttttgtttacttttaaataatcttttgaattaagatataacagccattcataacatacacaagtctgcagtgtccattaaaagattctgacatatgcatatacctgtgttactactacccagatcaaaaaatagaacaattttggtacccagaaggctccgtggtacctcctcacaatcagttaccaaccacctcccacccctgaccaaagatagtctatcagaattcagaagtcttttatcatcagaattgattttttcatgttattgaacttcatacaaacggaagtaattggtacatgttctattgtgtttgttttctttagctcataattatgtttatgagaaatatccatgttgttgctatgtaatattccattgtctcaattgtgaaaattaatgatgtgacttggggttattacagtcatacccaactagatgggagttaaggaccatggggaaaaagcactcaggtcacaaagctcctgctccaggaactgtctggcaagccaggctgcagaaataacttgctatatcttaaaacccattttacctagtaactgcttccatgtaactgctaccttccatgcctcaaagattagtttaccttccaccaagattagttttacctaccaccatcactcaacaattacagcttgccaaagctggaagaacttgtctaggccaatgaactttctttcaaaacattttacaaaacttttctcttaaccaataaaaccccaatcttttcttttgttctgtggacaccctgaagaccagccaggtctgtgtgtatgcaccaaattacaatttggtttttgcgtatatttccaaagaaaacctttctttgcatttgcatttctttgcattgttagacccaacttaacaaatgctttcatcctggcacataagccttatccacaactcatcataggtttgcaggagcacacttcatataaaagccacttaatgtggagatcttaagcttcccctcattgaaataatcacgtgcttcttttatcatcacagtttaaaaggcaggacagatgtgcctctctcgccaagaccatgttcccaaacagtaatgatggtaaactagttttatttttaatttaatatttttaagaacgggaatttccagtagttgttaaatcattatctgtttaagaagaatgtgaacttgaaataattgaggtggaacaagtccttaaagaatctcattatgactcatatatgagggtaataaggaagttaaaatgctcataatatttgtagaaaaaagtttggtgactatgtgtaaaataatgaaactgtactcaagtgagaatggttggtactacatgaaattaatcagattaacaatattgggaaaggagtttaacagctaaaaagagatttgagtttatattgttaaactgcacacgcatttttttaaatttgtgcaagaaaaatatgaaaaatacattgtttgaattaacttaattaacaaaaagtggcctaaaaagtagactaatagagaaattttcccaaggattaaagaataacctcaaatgggagagctgtatttaaaagtgagacataccagttatagactagaccagcagagggagctcaatatatttagccagtaaagacattgaagacagttaagattcttgttaagcagacacatatggaagaggataattacgtagttttattttaaatatgaattctcagacataaatatattcattaatgattacagataatttgagattccatcctctcaattttaattgactgccttagttgaattcaattattcgtattataagaacagaagtcagcctgtgcgacagactccgtctcaaaaaaaaaaagaacagaagtaaactatattcagcgtaagaagtgtgaataagtttaaaaaatacattaacacatatattagcatttttactgaattaaaaaaatacagcaatagaataatgagataaagttttgttgtagagtcgtgatagtggaccctgtgaataaaatacaacaacttaaccaagtgggagcaaaacattttatgattcttatgatagaaatatactaacaagttctaattttctttgtgcctatatagatgaacatcaaaatcacagctattttagctgataccattaaaaattaataaatattgaatctgatcattttaatggaaatgatatatgtttagaaatttggaagaataaaaagaaaaataccaaggtggacatgattaggtttgtaatacttaacttctgggatatttgaacaatgttcattgacactgcttgagactgtgaagaagtgagtgatagatgctcaaagtgatttcaaaaggaatacataatgatggagtatgtaggtaaggaaaggcttgcatgctgaaggagagaaataaaacttatggtgagagtgtgtttgcaatatcctgcaagcttttgcagaatgctattctataaagtctggctaaattgttaaggtaagaaatttaactggtgtagccatcttatagattgtgttataacagttttagtggtagactgatgaattatgtcataaaaaaggcactttcagaaaactggcaatctttaagtcttaatgggaaggaaatctgcctatgccctctcttttttccaagtcccttccctccctaccccataaagatgggtaagactttaaatctttccagctattgctgtgggaagtatttcatggacgcaatcatgtaaaagaaaaatatagagaagtatatttccaggtttttaggattacacatgtatagaaacaaaatgagaaaattgccagggctggaaatacaatttgagaagcctaaatagaacaaagccaatagtgattccttcaactgtggattttatggactgaatatgtacaaatgttgggtataaatcagggccaatttttccacaagaatctagaatatatcaaagtctaaaacaggattatagccactttagagaagaaattgcaccagaaccagactgtttctaaccaaatgacatacgtcttctctgcgtttacattcatatacacacattcatgttaacttagattgtatcatattgaagataattctatataatgcctccaaatttaaattcagttcttttccacaaatgcttattgtagttaagctatactaactttgaatagaatcacagagatgctggtaaatgacttatattgcatacatgagggaaacagctttttttttttaaatgatgcctgtataaagcctcttcctgttgagatagattccaacacacactcacacacacctctacacacacttacaccctcatatatgtaaaaatttgcatattagattgtttttcctagaaaatttactacctatttactattctaagtaaatagaacataattctctaatattggttttttaaactaataaatccttaagtattttatatcatcttttagttaatattaactttgagaagtatcacaaaccatacttactaaatttacaaagacaattctagctaatttaagaatcatcatctatacagtttcaaaaaaaataaaattggctgctagacaattttatagatgttcagtggttcatgtgtctatttctgcattttattacagttaaattgcccaataaaagctaaagggcaaagcagagataccatgtgctctttagaaaaagctataaaatttaagacagaagaaatttggtctgtaatgacaatttttatgtttttctggctttaataacttgattatataaaatgttttcaaatacagttgataaaatctataagtataatgttttggcaaataccatattcatttgaaaaagtaatcgaattgaatatttaaaataacattataaacaaatttgtaagtggggtacagagtaaacatgtaagtatttactactctgcttatgtctggatattaaagattattggaaaaaaataattgctatggtgacattttagcttttaatttgaagtttaatattagattgttgaatggagaaaatcaatgttgttttcacttatatttatatactctaatataccatctctaactgaaatgttattacctgcaggtgactgtaatttaattatactattaattttacattttaaaatcttgttatactaatttgggttttaaattacataaaatgttgccattaatgtaattacagattactctagtgtgaaacttgttgcaaagtaaaatgcctaccatggtcgtctctgcgatagagccaaagctgttgatgaatatgttgcatgtgacattaactggagggcctgaaaaagagatgaaaacataagggctgtttagagacttatctaaaacattttcaaataattccttgcattccattattattattccattttacacacacacacacacacacacacacacacacagatgcttaaaattgaagcaataattccacacaacaatatgtactgagaatcacaaggttcacaaggaacactgatgctgatcatttttttacctctcttggtcttagtttttaaaatctagatgtctctaatggctctgtaatgcctgatgctgtaagtccagtttctaagctcattcagggatagtttctattgatcttttccccgctgcatgggctatacttttctatttctttgcatgtcttatatttttttttgttgaaaattgaatactttaggtaacataaagtggcaactctggaaaccaggccttcccacctccaatccaaagtttgttgttgctggtttttcttgcagttgttgtttgttctttagtgacttacctggaccaatatggtaaagttttcatttccctagagtgcacagccagtgaaatctccatttagtgagcttagtggtaaactaatatttgattagagatttctttaaagccttgagccaataaatcttccactcttgccaagggtcttccatgggtttggggacatgtcttcagtgctcaggcagtttacaactctaccttacccttcacttcctgcttgcacagagcctgatgtccaccagaagtgagatactgggactctctgaggacttccctggacaggcacacagccctatgtgcatatgtaaactccagattgcaaggatatgttagagcttttcagagctgcctaagaacatagaattttccaggtcctttataatttttgttcaggctcttacttgtcccaactagtgtcacagccttaggcagctacaatgttaaacaatcttctaattattttccacaaatgccctagagatagaaatttttcccaccaagtgagttcttagtgaagtcaaataatggaaagctctttgagtgaggctcttccagggagctaccagacaggcagaatactgacaaagctctggggatggaccttctgaggaattccaaacttggtcagccagctctggtggttttacaacttctattgtttaggggtggctggattgcaaggctgctgtggaactgggaaggtcggtgaaattaatatcccttctgttcttacagaaattcatcagtttttcttgaataaacactcttcaggttgttgtaagctttttatcaattttaaaagttctaacggttaatcttgacaattttgccaatgtttttgttgcttttttggagaagtgaacttattgagtttctcactcctccattctggaaatttcttattaatgcccgacttagtattcatcataaatccaaggatttttatttttataaggcccatttattcattcctttactaaatatccaaagcctttgcacacaaaactgaagaagacacaaaaagattatcatctagcagagaaggaggagcagaaattggtaaattgttgtaagtttcttgctgccaggcactaccttagctgattcatagatatttaatccatagtaactctgaaagagggaaatattccatcattaacattttagggaattaaagcacagtgaccctacgtaagatgccagtaggtagcacatttagaacgtgaaccattgctctgattctagaaatcattcttttcccaccaccttgtttatatgaccttcaaaacatttcattatctggccacaaactttgttattaggcagatacctgtataaatagaaacgtaaaaatattttgtgctaggggctaaaatagctctgagttacactctatgtaagttagtcggagaacaccacatacagaaactaatatctaagactaatttctttgtttttttttaaactgagcgtaatttttgagtaaattgatcttacaaggtttgctacaaaaatgcctagtagccccttgacttatttctgtttccctctttttcagagataattacttcaattcatttaatcatcaattcttcggatatttacctcaatttctctacataatatgttttttcttttagacacatcttctgatgcccacaaagaagataaagatttagccttttttcatacatcatccctatctctactaacataagccttttttctgtcttcctgttatccaatatttttgtatgaaaaaaggcttggtcttttttgttagatcaatattcactttttacattaatatgacaaggtagatatttaccccagccaaacaatagaatatgttatgcttactttttcctttcctgcagaacattttcctgatattggcaattgcttcatatataatatttcacatagctttctccacatgaatcgttaacttatccacaagccctgaaatgtctaagttttgattcaatatgtacagatccatcaggttctctatgaactttaccttcctctggatttacagaggaatgtaatgagaatgttttgctctggttcaaagcaatcgttctatgacctcccaatcatgctaggaattacttccatagctttctgttgtgggatcctcgttcatggtcccatacttctttcttggtttatttcttcattttagtggaacatatgctccagtaatgttttgacaaatgctgcataaggctatgaagcttttgagagagtccttgttcatcaatgtctgtttttttgcattcacacttaatgtatagctagagttggtagaaacttttaggctggaaatgttttcttcttatgaattttgaagatactttttcactattttctatttttcagcattgccattgaaaagcccaaagccattttgtagatgacctgtttttctttctgaaaataaataggatgtttcatttgttccaatattttttaaaaactatttcattagttagaatggtctaaaatatcatttgaagttgcaatttacatttatttgattactggttcatgattttcatcttaatttgcttttcaacctattctctagatggctatttatcttgctgaattaaggtagaggaaaaatcaataaaattatttaaaaataaagtttaggtttcaaaggcctttaaatcctatactacacattgaaatcacctggcaatctttacaaaccatagatgcttaattctcacctatgttacttggtatggcatgcaaccaaggcatcagtatttttaaaagcttcctaggtcattataatgtgcaagaatgcttggaaaccactatcctaaggaattacagactagaaaatatctggggccattatactacagggttatcagagattttcttagaaatagaaaaatacagagagaggagtcagggcttgggagcattgaaaattccaggctattaatttcattaaaagcgttgcctattataaattcggtgaacactgttaataaaacagagtagatgctatgtactttgaaagggcctaaagtttactaaacataggaatgtctagaacacataattcaaacatgtatagaagttaaattgttttaaatatgaaggatgaacatgtaataataagaaccttataaaagacctgcatcctaggggcgctgtatttagttactaatgaacattttaaaatatcttcattgcttatttctgaacatttacaaatttctaaaatttgtaagatgagagcagtgtgttatgtgccactatgtgggagaggagtaaacttagtttactccatgattaaaacaaaattccatatatacaccatggaatactatgcagccataaaaaatgaaagagttcatgtcctttgtagggacatggatgaaactggaaaccatcattctcagcaaactatcgcaaggacaaaaaaccaaaaaccacatgttctcactcataggtgggaactgaacaatgagaacacatggacacaggaaagagaacattacactctgggaactgttgtggggtggggggaggggggatggatagcattaggagatatacctaatgctaaatgacgagttaatgggtgcagcacaccaacatggcacatgtatacatatgtaacaaacctgcacattgtgcacatgtaacttaaaacttaaagtataataatgataaaataaaaaaataaataaatgaaatttccgtcctaaaaaaggatgaggttacaactgtcagaagataattttttcttaatgtgagtctaatatgaactctgaaaagtatctgtaggctgactggcatccttgaaaagctaaaaccaatctttcatattttctaggttattctctttttccaccagataatactagactcctactattttctttttttttttcttggaatagcaatatgaatctgagaaacattatttggcttgagataaattctgtcatgctctattgactcatatcctctggaaaaaggaaaacataagaacatcagtattgggttaattcacctgtaaataaaatgctgatggggtacagccatgttgggggaacatggcccaggaggaagctactattagaccactgctagctgcacctgattgggatctttttggctgaaacggaaataaataaaagagtggggagataatttttcttattttagtttagaaagggaaggggtctttatttcttggattttagtttgtcacaggcattgaataaaggatgaggcattctctataatacattttgtctcgtcttttaaatttaattagtttctatatatttatggacaattgtggtgaaagaggcaaaatggaggcaaaaattcagcataggcttcaaggttctgaagttagtgaaatctgtgctggcacatttcagtgtcccttgggagcaagtgttatgtggcacatcctaatgagtccattaaggttctgaaaggagcagtgttaggtaccgtctttggaggagcaaacttctgatatatttgttttctttctaaaatatggtgctgacatccctggttgaccagaggctcaaatagtaaggccgatggatgaaatacagaaaataacatcatttccacagaagaataatggtcaaagaattgactaatttaggctttcactaataggtgggatcataatgcctcattgtatttgaaacagacttcagcctcagcctccataacattcctccaataagaagcagaaagctcttcctaaaggtgaaaagttgcctggcttcaaaacctaaatttcacgtgcaagtaaagtaactcacaatggtctcaggcctaaactttattctccacctggttataacatgttccttgattggatgttagaacataaaaaagtgtgatttggttcccatttgactatttacttgtgtatatattttcttcttcagcagaaagaagggtgaatgaatttggacatcaaatcctaattccaaatttcaaaactatggtagacacttacttgaaaggcagatagatagacacatatgcataaataagaataacttaaaattttaaaatattcaaataaaaaacagtttggaaataaaaatcatttcagatcatagagtctcctcaatgtaataacaaggtatttgggatttactttaggaaagctttggagccataacagattcttaaccttggaagtgtaggaactaacatgactcgtgaatgtttgcatgaacaggcaaaagcatagagacagaaaaaacagaaatttatgataatagtctgggatggggacagaatggacctgaccccgaaggacaatgacagtccttggagatagattacaaagaatgaaatggatacagcatcataatattttaaaggtatcacgttctaccccttcggtttctggtgcacatgagattagtgcagcaatcttggagtagtctttctatcctagctttgaaatagacattcaaaaattgtgtagagaacgaagctcagagaagattatgaatcttctattgccattacagagagcacctgtttagtagctcttggccaatctgctacttctctgtgccaatgcaaaagctgttatatctatccaatacactcctatgttaagcaacagagcaaataactgctatagcatccatatggcaaattgtgcttttaaattgttcacgactttaggcatagtccttaaaagcaaatgacagtagttgcagatgttttcagcagtaagttttcgtttagatgttttttttttttaaagaaatagaagatggcccttaagtttaagaaatgaagtgatggcagaatagcaaagtacaatgcaaaatcttggcaacgatattattgttattcatattggggaaaaattgttcactaggcagacctagagcaagtaagaaaacaaacaaacaactcatatgttcataaaaatgactaaggaagttttcagggagtgttgtattaaagttttatctttttaaagacacagaatgcaactaaaagattaaatttcaaaataattccaactagagacttgttttattttagataaatgcacacacatgtcacaaggagagacgttattttattttttattcacaaagcatatttgatgacttaaaatccagattttaaattatctgttaggtgctttaaaaaggtttgtaaattatggcatagaagcagaatcctgtttgttcttcccctttctctttcccttcccttctcttcccttcccccaaatgctgcactaaagtcatttgtttgggcagtgcaaaataggcttaagtgctgggatggctgagggggtcgtagtaacctaaggcaggagagaaggacattgtggaaaagctccacatgcaggaaatgttggaggtccggtgagagaggaaaatgtacacccacaatagggaagcctgttgttgggtgttagaaccatagatgggcaaggtgtgtgtctccatggggccatcctggcttgcagagttggagtctgaacaggcatctacacaaggagatgaacctgaggaaggcttcagagtcccaccaggccaaggaaggtacttgtgtaaaagaagaagtagcagcaaacaagggagattcattacatattgattaaataagtaattatattgaggataatgggagcctggtttcttgctgttggaagaggaagttaaaatatggaaacttagaaactagactaaacatatggtattgacagtgtgaattcatggttttcaatagatacagaagtatagaagaaaatcgatgtgtaaatgtatgtgtgtgtgtatgtgtgtgtgtgtgtatgtgtgtgtgtgcatgcatatgtgtgtgtttatttatgcttatatgtgtgggtatatatagatatatcctggcaggcaccaacttaatcaggtaatcataacctgtaatggcaaaatctgacatggtccaccatcaaatagaatgcagtcaaaacacatcatcattcctgtaatatccctgctaaatgcactacctaatttgaatcatgaggaagaatcagacaaatgcaaagtgaagtatattcttctaaataactgaataagaatatttttaaatgtcaacatcatgacagtcacagaaagaataaagtgctggttcagactgaaaaagacaatgagaaatgacaaataaaatatgatgtgattctaaactgaatacttttataataaattatcagagagtggatgaaatttgaataaagatcagcaaattagaaggtagcaatctattcaactacttttcttgttataatggttagattgtgattatcaaggagaatgtttttatttgtagtaaatactcaagtattggggcatcaggtcaacaacttacattgaagtggttcagaaaaaaagcttttgcacttgtaacacttctgttagtttgagattattgtaaaatacaaaaaagagaaataattactacagaaataattaattaaaaacaaaaagcaaatacaaacaaaaaatacagggtttagaatctaaccccatcaacatttcaaatgaacatgtatagttttagaagagcttattattcaagagatacttcttgttaaagtgacctcgtactaagtaaaaatgcaaacagaaatgtaccattttcaaaaataattgtaaatgttattcaagaacaatagtgtcttggtggataggaatagtaaaaatgggtaaaggagacctttaaaatgctaacatttaccctaataaaaatgcatgtagaaaatgagtttgggtacacatgccacccttggcatggatgttgttgtagaatagagtactagaaagagtcaatttgtgatgaagggagaaaaggattagtgaaatatttaagggtaaaagacagaaaccacaaatacatcgtgagggcaaacaaaagttatatctacatacaaagagagtggccattggagataacataagaaaacaaaaatgcaataaatacttgggaggaagacagaattgggtgattactgaaggaatactttctgaagttgcacttatgagtcataagagggaccccaagattaggatcaaaagaaagaagtaaaatccagcagtggtgggtaaaatattctagtgaaataatgttttgttgtcttataaacatacttttacttgcaattcaattgttttatgttaaacatgcttctagtttcagatgacaccttgaagcttctatttcaagacagagaattgaacgtcattttctttctttctgaagacataaaaatgacattacataataaaattttagtgagaataaatgtatcataccaaaaataatggaaaaaaaataataattagtttaatgacataaaatatagagccagataaaaatggttgacaaatgaaacagaggtaagcctaaaataaaagcaagcagggactgcatggagaggggaaggaggtggagagtgagaaggggaccccagggatagggcctggcatctgtcttgagagctttctgcttcccctctgtatttctgttgagcaacggttgcctggtatttagccctatggaatttttgaggaaatggaaataacttctttgatgattagggcaaacacagtacctgaaaatacctcaaaccttaagcctgctctatttcaccatctgcaggacccaagaataatgcctagtcgaagctcaacactcacctaaagcaaagctctggccagggcaatgcagcctgtgtcagagttccctttcgaagtagagaaataacagaaaaatggccctcctatagcacccaagctaatcacccctcaattcttcctgaatcacagacattctatcacacataagaaaactagtggtttaaagagaatgaacaatataaataaacataatttatcctgcaggaagaagcaacaaatcattgggcagagaagaaaaacaaaaggggcagaatgcaataaaagacgcattaaattagcagtctacttagtgcaaaggaatctcgtaatgcctgtgttgtgaaaggcctagaaagcaatcaaacaaattagaacagacaatcaacagaaataaccaatttttttggagtgtttgcctcaaagaagtagaactgtgcatcgttagtgttgagggtgaaccgctgcttttcatcattgacacttgtagacatttttttagcagcttcagggacatgattgttactattgtcataaataaaactgacaagcaaataaacatacaaaatagcacctgcgtagcagcttgtaacacaacgtccacaacttcgcattcaaggaaaatggtttaagataaagaggattgtgaagagaccaaaacacaattacagagttaaaatctccctaaacattcacaaattggataaatggcaccatgtaactgaggacaaatctgaacaattctgtttataatgtagagggaaaggagaaaggagagaaggggatgagggcaatgtgttagacacagatgactggggaagatagcagattttttaaaaataaagaatattgttttacagaaatgacacaaaacagtgccagcataagcaaaaatcctcctactgaaaaatgtccagagataggcagaaaaaaatagcctatatataaaggagcagaaatcaaaatgagatttgacttctttatgatattaaatgtcagtaggcaatgaatcaacatctgcaaacttctgagctagaattctggagctcgataattgtataaagtttctttaatgtcaaatgcatacaaaacagattatcctggaatattattcaatgatgaaaagaaatgagctatcaagccacgaaaagacacagaggaacctgaaaagcatattgctacctgaaagaagccaatttgaaaaagtctacatactctatgattctaattatatgacatcctggaaaaggcaaaactctagagacagtgaaaagatcattgattgccagagactgggggtagatgaggggaagtgggagagagatatactcataccacaagcacaggagattttagggcagtgaaattattctgtatgatacagtaatgacaaacacacgttgttatgaatttgtcaaaacccataaaaaatgtacagcacaaaaatgaactctaatgtaaattatggatttcagttcataacgtactaatcttggttcatcaataataataaatataccacatgaatatgaagatgccaataacagggtacactgttggggaggagagggcagatatgcactttccaatcaattattctgtaaacctaaaactgctctttaaaacaagtctattaatttaaaaaagtcagaaaaaccagaactcagaaaatatataagcattactcctgtcttgaaaatgaaaacctattttattttattttattttgtttttcagcaaatggagacaaagctagaatatcctactgtttagtcttcaagttataatttatatgtgtgtgtatgtatgtatatatatatataaagaaactaccagtttcaaggattattaagtcttcccttaattcttaacctggccctccaactctgtaacatcgttaggcagtgcctcccagtgagcgccaaggcctgtggtctgcgcctggggatgtggtgctttctctcactgggccggttctgtttctgctcttttccctaaccagaaaggcttctaaagagaaaagatttccaattctgagaaagaaatggtggaatctacctattattttcattttcaaaataaaaataactatttcttttcttttctttttttttctttttttgcttttaccatgtctcatatatttttctcagccacatcatgggataaaacaataacaagctaaccagatctgatgtgaggttggtaaaagaaaaaaaacacaggggggatgagccaagatggccgaataggaacagctcctgtctacagctcccagcgtgaccgatgcagaagacgggtgatttctgcatttccacctgaggtaccgggttcatctcactggggagtgccagacagtgggcgcaggtcagtgggtgcacgcaccgtgcgcgagccgaagcagggcgaggcattgcctcacttgggaagtgcaaggggtcagggagttccctttccgagtcaaagaaaggggtgacgcacctggaaaatcgggtcactcccacccgaatactgcgcttttccgacaggcttaaaaaacggcgcaccacgaggttataccccgcacctggcttggagggtcctaccccacggagtctcgctgattgctagcacagcagtctgagatcaaactgcaaggcggcagtgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacttctgcagacttaaatgtccctgtctgacagctttgaagagagcagtggttctcccagcacgcagctggagatctgagaacgggcagactgcttcctcaagtgggtccctgacccccaagcagcctaactgggaggcaccccccagcaggggcacactgacacctcacacggcagggtactccaacagacctgcagctgagggtcctgtctgttagaaggaaaactaacaaacagaaagaacatccacaccaaaaacccatctgtacatcaccatcatcaaagaccaaaagtagataaaaccacaaagatggggaaaaaacagaacagaaaaactcgaaactctaaaaagcagagtgactctcctcttccaaaggaacacagttcctaccagcaacggaacaaagctggacggagaatgactttgacgagctgagagaaggcggcttcagatgatcaaattactctgagctaagggaggacattcaaaccaaaggcaaagaagttgaaaactttgaaaaaaatttagaagaatgtataactagaataaccaatacagagaagtgcttaaaggagctgacggagctgaaaaccaaggctcgagaactacatgaagaatgcagaagcctcaggagccgatgcgatcaactggaagaaagggtatcagagatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaagatatcatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagctgctgcaaaatcatgccaaaatgtaaagaccatcgagactaggaagaaactgcatcaactaaccagcaaaagaaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaagtcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccacattcataaagcaagtcctgagtgacctacaaagagacgtagacacccacacaataatgatgggagactttaacaccccactgtcaacattagacggatcaacgagacagaaagtcaaaaaggatacccaggaattgaactcagctctgcaccaagtggacctaatagacatctatagaactctccaccccaaatcaacagaatatacatttttttcagcaccgtaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatagaaactgaacaacctgctcctgaatgactactgggtacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcactattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgagaaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacatgctctgcaattgtggcaataatcaatagcttaccaaccaaaaagagtccaggaccaaaaatggattcacagccgaattctaccagaggtataaggaggagctggtaccattccttctgaaactattccaatcaatagaaaaagagggaatccttcctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctctataaattaggtattcatgggacgtatttcaaaataataagagctatctatgacaaacccacagccaatatcatactgaatggggaaaaactggaagcattccctttgaaaactggcacaagacagggatgccctctctcaccactcctattcaacatagtgttggaagttctggccagggaaattaggcaggagaaggaaataaagggtattcaattaggaaaagaggaagtcaaattgtccctgtttgcaggcgacatgattgtatatctagaaaaccccattgtctcagcccaaaatctccttaagctgataagcaacttcagcaaagtctcaggatacaatatcaatgtacaaaaatcacaagcattcttatacaccaacaacagacaaaaagagagccaaatcatgagtgaaatcccattcacaattgtttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcctgaaaatggccatactgcccaaggtaatttacagattcaatgccatccccatcaagctaccaatgactttcttcacagaattggaaaaaactactttaaagttcacatggaaccaaaaaagagcctgcatcaccaactcaatcctaagccaaaagaacaaagctggaagcatcacacgacctgacttccaactatactacaaggctacagtaaacaaaacagcatggtactggtaccaaaacagagatatagatcaatggaacagaacagagccctcagaaataacgccgcgtatctacaactatctgatctttgacaaacctgagaaaaacaaacaatggggaaaggattccctatttaataagtggtgctgggaaaactggctagccatatgtagaaagctgaaactggaacccttccttacaccttatacaaaaatcaattcaggatggattaaagacttacatgttagacctaaaaccataaaaaccctagaagaaaacctaggcattaccattcaggacataggcatgggcaaggacttcatgtctaaaacaccaaaagcaacggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagagtggcaatcattaaaaagtcaggaatcaacaggtgctggagaggatgtggaggaataggaacacttttacactgttggtggtactgtaaactagttcaaccattgtggaagtcagtgtggcgattcctcagggatctagaactagaaataccatttgatccagccatcccattactgggtatatacccaaaggactataaatcatgctgctataaagacacatgcacacgtatgtttattgcggcattattcacatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaccaaacaccgcatattctcactcataggtgggaattgaacaatgagatcacatggacacaggaaggggaatatcacactctggggactgttgtggggtgcggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaaatacaaaaaaaaaaccaaaaacacaaagaacccctaataacatcaaaacttagatgcaaattcactattcttaccaatgacctgtgcctaagtgaacataaaatcaaccatttctatacataacatttctcttccttaagaccaaatttttgaaataatgacttggacaaaattctaatttctattgcatgatcaactggttgagtgatattttcagctttactttctaattctttttagcagctctcagaacatttctaaacccatatatcattattaaatgccttttaaataatagtttttaaaatcattatatttaataggactaagatataatagaaatttgaagtagtttttatacttatgtcaaattatcctaaaggcacaggatcattagtggagaaatctgattctcaaaaatgtttcagataaattaatactattctggaggggaagagaacagattaatcagtgaaaaggaaagataatgttaatgagttaagcacctaattattttaacttatttcagtattgatttaaataatgttcgatggaagaggctgtcttatccatggtcaataccaatttaaattgctttaagagaattatttatttatacttttctgtggtacattttaataacattaaactacttagtcttcaagaggtgagatttttttaaagtgtactttttaaagagaaatgacaaaacaataaaaacaaacaccataattttggttaagtaaaaaaatctacttctaaatttttgtaaatgttagaagtagaaagcagcaaaatcaaagttgcatttttacaaagtcgtttgtattttttaatagttgttttcccactatggccttcaaaataaattttctttcaatataaagatacttgtgaaaacaatcacaaattttatactattactccagaaataaattcataattatgtatataatgctggaacatttcttatttttaaatatttgaaaggcaaaaatgttatattactgttatacactttgcttttggctaatgagattaaacatttccatttcgtttctgttaattgtctgataatgtccatactgaaattttatgtttgccttttacaaaactttgaagtccagagagggcaaacagataggtattttccaatgctttcatattttataagcacctttctatcagctgattacttatctaggtaagttatgtttctgtgtgtttaggaagaagtgaggatcaaatcatttaggttatagtaatatatttttacatatatcacaattcccattcttcttcttttttaagagatagagtcttactgtgttgcccaggctggagtgcagtggcacaaccatagctcactgtaacctcaaacaactgggctcaagtaatcctcctgcctcagcctcccaagaagccaggactaaaggtgtgtgccaccatgcctggctagtttttttttttttttttttttttggatagatgggtgtctcagagctggtctcaaactcctagcctcaatcaatcctcctgcctcagcctcccaaagtgctgggattagaggcatgagacccattcttcttttaaaattattttagctaattatgctcatttttaaaattttaatatatattactgatattcatgtctctaaacttgcttactattaattcattgtctttgacaattggataggaaagcatacataacaccaattttaaattagttcatttgatgagctaactagattccttccaaaaacattgatgtggggaaaggcacaaaatcaacaaggcaagggattgtatttttagtcatgtgaactaccacagagaaaaaatgagtgcaatattatcaggagaacaggttcttcattttctacatctatgtttgatgagcttatttttgcctgaggtgaggtgggcccctaggtacatgacgacacaagggctgatcattctcacctccttttgtgtaaatgtcttctgttaggtattggattcagtttgttagcacctaaatatcctcctgatagccgtaaggaagaaatagcatgtaaatactattttatttatatttcaatattgggtaatgaaatgatggtcaaaagatgatgatgttattttatccaatgaaatgacacggtgttgaatatacttaattagggagtagagttataagtatgtttgctgaagtcaataatgtttgacctttgcaaaagatgacaaagcaaaagtgttagctaaaaactaatccattaaattattactttttataattgatattatttttggctatcaaatgcagcctgaattttttttctaatgttcagagcacaagatattttgaaaaacaatgagagaaaatcttcctttttctttttcttcctttagtgacactggggtgtaagaatgaattttagtctcccccaaaatctaatcacctctgaactggcttggtgatcagcttgtttttaggaatacatttttacttagaaaagaatcagtatttgttttaagcaacaccaaatccttgggggtcctttcctgatcttacatataaatagtaataatcacatttttaaatagtttaatgtttctgttatcttttaaactattaaaaaaataaactaacactaaactttccaagagaatggcaaaagcactgaggccactcttgtgtggttggtaacttatctgcagttttattaaaataactgctgagactgtttatatgctttttaaatattcacagacatttaaaaatagaatgcattttcttctttaattttcagttaaaagaaagaaatacttctgaatcactgaatatggactcaccataatgaatctgctaattcccgattatgtgtcttgtggtttagttaaatgacaactgcatatttttgaagatcaactactaattagttctcagcggattcacaggaatactgctttccctcaatttggaaaagatcattataatactgaaatttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtgctatttttgcacaacttgtactcagtgctttcctcctgaagttgaaaatatttatggttgaaagcttaaaaacaaatcaagacatgtgatccacaatttaaatattaaactcattttaaaattgaagccattcataattttccactcagacattatcagtgagttttacttcttttgttcctgctacccaatcttgatatttttttactccattctagttatttcacccactgctaagcatttctttttttcttccataaggacaaattcaaggaaaaatggtagttatagacaacacttttttaaactttagcaatgaaacagcttaactgaatcccatgaaaaaagtgtatgttctttaactttgtttattttctttattgggtaaagtaatattcaagaacatgttaaataagttgggatctggaagcagctttctaatattttaccattaaagtgaaattacaggatatattgtggttctggataagttacatatccttatataaacatgttacttacaactatattaaacagaagaataaaaagtggtactcttaaataattgacaattacactctttcctagaaatttgggtaaaacatttggtaggtgcaataatgtcttatacatttcaaaggctgtcagttagcaatccagactgtttcccaataggtaaattcaacaacggttagattccccacaatatagacagtagtaaagtggctgattaaaaagatgggaaagtttatcactagcaattaaagaagcttccattccagttagataactgatagaataattaaataaaggatacgtacatatatgtatattcctaaaatcaatggtcaagacaagaagtattataacagttagagaagtaaaaaaaaaaaaaaaaaaaaaagacatagctgggccaaagaaggcaaattatgataattgagaacatgggaatggatttctttttcaagacaccttggtgactaatgcaatatttggaagattgttgaaaataagcattagaatttctggtggaattaatttaaaactgtaccttgttgaagtatatttaaaacacacatataaagtagcaaacagaacaattacctttaaaattgggtctgattcttgcatcatatcctgatgtcctgcccattaatttatccagaaaatcagaaggtgacattggagcacttcgagatcttgcactgtctgtttcctttgtggcaaccaaactacaaataagaacaaaaatatagactttacaaaaagaagtatttctaataattgttacctacaaatataaaatagaaatgctgagctaaatatctttggcaacaaaacataaacctttagatatcatacagtgaagattataataagatagacatttatagatttatagtcaatacttgtaaggtttcatatctattcagtccaattgtcagaggtggcattcttttgtattagacctgaaaacaaaggccacttccaaaatattaagctttcaaatctgtgtttacaaaagccttatttctgatagcaatttttaaccaaatgtatccttattgctttaggtgtaagaaaacattaaaattcaactgtgaactacaatcttattgcttttattgagggaaaacatctcttttcaggttttgtgaattattcttagcagtaaaaaacttctgtctaataaattaaacaatgtttttttcttcaattagagtgcttcctgaattagcaacacacaaagttaaattcattctgcttttacctacatgtcattagtctacaatacctttcgttcagatctaaaatttgtgtgtcaagattgagaaattgccataaatgtaccatgtgcacctggatattatattagtagaacctgtgtccaggaaaggtagtgtgttcctatattcttttcattcaattttttcctttgtgtccagccacttatcctagaaacccatagtgtaggctgcttctcctgtccagctcttcacttacatagccttctccaacagaagctggggcctgcttgttaagatcaaatgattctttttatccacagagttttgctcaggaaagtgacactgactttctggaactgatgtgttcaagctgatgtcacttcctgaagatcatcaatcatcacatgctcccagctctgtcattcaactcaggacattgccaaatcaaaccatttgggtcaccacatgatcataacaagatcagttattaaattccttagatttctcctgccagaattttagtgagaagtacaactggggcttagagccatcatcattaagttgtttaccacagggatatatgcagtgattcatgggcacagttttaaaatctcatcaatcttggtgataatatgagaatgagatttctgtaagcacagaatcacaaataacactatctattagctgttgccctgttctagaggttctgtctggttctgggcactctgagtcacttgtttccccagtgactctcattctgtcattctcgctttcttccagaatggaagcgttttttctccctattctgttggctccatgtgacttcgtgatcctttatctctgattattattgctcaaccaaactgtcattgtgatcattgggaagtttattctaatacaaaaatcattataataataaatatatttttttaaaaaaacctatcttctcaatgactctagagctttattctaccatctggttttaagtaactttttcctctcctatcaagaagcatttgtttatattccatggttcaagaatagtgtggaaaagcatcgttggattttgtagctacatgctgctgcttttaaaccattctctttatttcccttgcaaaatctctcctttcaattatcagaaaataaacttctacctcctcctaccaacaaatataccaatttatcttgacctgaaccaataatactctgcctccttctcttttaaaaatactagacgatggccgggtgcggtggctcacgcctgtaatcccagcactttgggaggccgaagcgggtggatcacgaggtaaggagatcgagaccattctggctaacatggtgaaaccgggtctctactaaaaaatacaaaaaaaaaaaaaaaaaaaaagaaagaaattagccgggcgtagtggcgggctcctgtagtcccagctactgggaaggctgaggcaggagaatggcgtgaacctgggaggtggggcttgcagtgagccgagatcacgcgacggcactgcagcctggaccacacagcgagactccatctcaaaaaaaaaaaaaaaatactagatgactatgtatactgaaccacaatccttcacattgtgcacagaatgtgggaacgttatcctagattatcaagggcagttctatatgcaacaacatgtaaggatatatgtatgtataaagatacatgaaacagtatccttataaggatatttatccttataaaaaggaggcagaattatatttgatgacagacagaagagggaaggcaatgtgaccatggagacaggaattggggtgacgcggccacagcaaaggaatgctggcagccaccagaagctggaagagaaaaggaatggattcttccccagagtttctggaggtagcacggacctactcacaccttgattttgacccagtgaactgattccagacttctggcctgcagaactgttagagaatagatttctgttctttgtggtaatttgctacagttgccattggaaacgaataccaaccttctattgaatttttcatgtctgtcatgctgcttttcaaccccagaattactctttggttctttttttataatctctatctcattatttcctttttggtgggacactatcatactttctttttagctctttgtacatggtttcctttaatttttaaaatgtgcttaaaatagttgatttgaagtctttgtcttgtaattgcaatgtctttgcctccctaagcatgcttctattgattgcatttttcctgtgtttggtccatatattttcgtttctttgagaaacttgtaacttttattgaaaactggacattttaagtaatatactgtggcgactatggaaatcatattgtcttttctccccagagtttggtgttgttgctcttttttaaatggacttttttgaactaattctgtaaagtctactttctttataatatgtgacaattagaatatctacttggttagcttagaggtcagctactaattgaacatggattttattaatttctagaaccaataagtgactcagtatttgctgggggttctgtgtcatggggtcataccttcaacactatgtcaggcagttgattactctggactttactttcacttgtgtgaggcctaaaagtcagccagagttgagcactaagggtgttttcaggtctttcctgagcatgcacacaaccctgggtgtactactttgctagtgctgccatgacatagtatcaagaacaggtggctaatgcaacagaaattaactttcccacaattctaaaagtccaagatcaagttgtcagcagggttggtttcctccgaggccctcccttgttggcttgtagatgtccattttctgtttttttttaatgatcttttcttcacgtgtgtctgttctaacttcttcttataagcacacaaggcatattggattagggcatattgttttacatcaattacctcttggtaaggtaacagaccttacctccaaataaagtcatgtctggaggtactggcaggtaggacttcaacataggagtgttgggagaaaaaaattcagcccatacgtgtggccttccagataaccaggaatatatgcagtttttccaaacccatatggacatatcattccaatgctttccgtttaacatttttgttaagtatattgtgtgcccacactattactgattgccttaggcacctgtgaagttaaaaaaatgactctaaatgttttaaacaaacttcttcaggaaaaaggcttttggcggtgggtgaactccaagttaggtcacagaaaaatagatttgcaaatggggtcttccagaaaacctgcagacaagttaaataatgatcattcttaaagaataaggccttaaaggagttcagactccatgctgtcccctctggtggctgccaggttgtggacttttcctgtaatttggggctattggtttacgttgtcaccacggagctgaagagagggggtgggaagttgagcaaattataatgccacaaatcccactgtttttactaagagaaaaatgtttttcttcaatatacaacttcaggaatcactacaagcctctgattaattgtcagacttttgaaaaagttgattctcacaattatttttttgccagttttcttgttgctttcataaagaagagaatttatggaggtccttactctactatgtgtttcttactgtattatttttgctgatgtcactctctaataatgccttcctagacttctttttatatttgttttactatatctttgctttaaataaccatgtccctcacagctccattctggagctcttccattgctctctttgtgagtaattttatttactcccatggtatcaactgcataccatgataccattttgcaggcctttcaaaaaaatacctgttttcttaagtaatgtcaaaatttacattcatttatttatttatttatttatttatttatttatttatttatatttagagacagggtcttgctctgttgcctaggctggagtgcagcagcacaatcacagctccccgcaacgttgaacttctgggcttaagcgatcctcctgtgtcagccgcctaatggggtctcactatgttgtacaggctggtctccagctcctggactcaaacaatcctcctaccttggcctgccaaagcactggaattagaggcatgagccactgcacctggccacgatttgcttttaaaagaaaggatgcaaagtctgtttttaggattttcctataatatatgtccaaaaactgtagagtaaatattctaagtgactgttattcttgtggcaataataaaggaataattctatctatcatctatcttttcatatatattttcagatatggcaagtattagtcagcacaataaagaaaaaataaaagactaagattaattaagattaaatcttaattaattttagatttaagattttcactatctaccaacaactttgacaaaaaagtaattttatttatctaggcagaccaatgctaaattttaatgataataatccctttcattcatgcaaatcatatcttgcaaaagtctgtctttttctagttttcattaactcatttctaaaatatttttccaaatgttacaattgaacattaatcttaaaatagaataagaaaataaaaaaatcacatttttctcatctcatactaagcaatcacttatccattgaaacccacctattataatagtttgatatttgaaccaatatgagaaataaggtattaaaaattctccagtagtggatgtagagatgtcatctctgtgcactttttaaaaaaatattactccaaatacaagtagtggtagggactggcatgttaagtgccacgtgatgcttgcattttctgtagtatatgatcatgttgcttaagaactcctagaattctggacatttataggaaggcaacagcgttaaacaatcaaaatacaacacaattttatgcacacacgcacacacacacatacacaccacacactatgctcactataattgtattgtcccaaattcctggttgaatatttcaaaccctattaacaagcactctcagcacccaattatccctttcgaataactaaatttaaaaagcaagatagttattgtttaaatatgacaaactcattcttaatctttttgaaggttaaaaattgttattaatattttaagtcttatctcatttcttttgatgtattcaaaaaacaataattgagctactgcaataactgctttcctgaaatttgatctgatattggttctgtaaaaattctatttgaaatatactttcattgccaaaaatatttgcttccaagtatattacgtaaaaatcatgactaattcaccaggggtgggaatatataaaaatccatttaatagaggacaagagttttatgagtagtggctcattcatttatttatttaacagccgttattgacatgttccaaagagcctggcatcatgcctagaatagtctcaaagagaaaaaagttagaaataaataaataattatatatatttatattgtatatatatataacctcagtgcttaacctttttaaagatcaacatgttgttaaaatagcttctgctaatatataaattttccttgtttatgcaattaataattaaattaaactggaggaagaaaaacatactaccttttatcactaacatagaccaagacggaagatatatctttggtaaatacctttagaaagatgtgaagtatttcatctggtagcagaaaatctactaaaattatctgctttctctgaaaacagttatatattttatagtcaaatgtcccattatttttttctattctttaatactggaaattaaaaatatattttaccataaatgtgaattaaacacaaaattatggttcttttgacatggcacttaaaattaataaatgcacaaatataatttgataaatgtattgagagctatacatgaaatatacattggtctgggatggaggaggaatatgtaagaggtgataaactgtttttaaagtacaatacacaaacttttataagccttttataaatggagaaaagtttactactaataaaattaaagtgcatttatttattatgtaaaagtatcctttcttataccataatgtaatcaaatatatggtatatattgcaaaaatgatttttgagttcttatgtaatttgttcgatgcaaagcactgtgctacaaacagtaaagtatataaaacacaaatctgaatctttaaagtgttcacagttcagtcgattactctgtgtggtctccttatgaagtgagcaggagctgaaaaatgagaagataatgaagtaaatgatccgttggttcccttcttaatacggtgtgagcaaaatccttatgttttgtaacaggaatcaaaaccaaactctacagattgatgcctataaaatgagaaaattctgaaaagattaatatttaaattttctttatgacttgctatggtctcaatgtcatatggtctcaatgccatgaattttggactccccaaaagtcatatgttaaaattctaaaccctaagttgatggtaataggagtggggacctttgggaggagattcggtcataagggctccaaatgagattagtgcctttatgaaagaggccccagagattttccttgccccttccaccatgtgaggttacagtgaaaagagagtggtcaatgtaccaggaagcaggcccaaaaccagacaatttgctggtgctctgatcttagacttcccagcctcaagaaccaggagaaataaattgtgttgtgtataagccatccagtttatagtattttgtttttgcagcctgaaaggactcaagtactactgatgtttccttcaatgatacagactcattcaattgcttatgggcaattgattttacttttaaagattcacattttttacacaaaagaatttattgttggcaaatttacattgagttattggctaaaaagcatttttacatagtctatccctttctttctttcttttttttttttagacggagtctcgctctgtcaccaggctggagtgcagaggcgcgatcttggctgactgaaacctccgcctcctgggttcaagcgattctcctgcctcagccccccgagtagctgggactacaggcatatgccaccacgcccagctaatttttgtactttcagcagagacagggtttctccatgttggccaagatggtctggatctcttgatttcgtgatccacccttctcagcctcccaaattgctgggattacaagcataagccaccgcgcctggccccttcctcttctgaaaggggtggaggctttgcttacagaaagacttcctatcagctaaactcttactttaatatatttctcctaaaactttcttcttattacagtaatatctgagccttgtaccatgtgaacattagcagacagcccttagaaaactagtcatttaagggaactcacagtaataaatacatagtatgaggctccatataaccaatttggcagcctactctaaatttgaaatagcccacatcatttgtacacacatattcaaaaactttttttaagttttttaaaactcagggtaggaagaggcagtgaaaagaaacccaatattaatttagaatgaattttggataagaaactttaccatcaaagccatttctattttgtctaaacctcctagtttcaacagagctgacgtatttatagcaagttactaagattgttagcaaattagctatgatcggtactttggaaggaagcagctttgactttttcgaatagtcttttatttatgaatctcctcaaaatctgtggtaattagcttgcctcccacacttcactcttcttttctgtgctgcaccaagtatttcatttactattaacttttcttgggaactctgtgtgggctcatacacattcccatcaatgaattttttttaacttaggtattttatatattcttatttatataaagacatgctacttgaaagttcagaaactttaatttcataaatgttggcagaaaccaattcattcaagtattgaaacagaacatcaaaatctaacaataatatccaataagataagagagtaatagctgggtgcattggctcacacctgtaatcccagcaccgggcggccaaggtgggaggatgactgagtccaggagtttgagaccagcctgagcaacatagcaagacctcttctctacaaaaaaatcaaaaattagctgaagagatagcaaacgcctctagtcccagctactctgaggcaggagaatcacctgatccctggtggtcaaagctgcagagagccatgactgtgtcactgcactccatcttgggcaacagagtgagaccctatctcaaaaaaaaaaaaaatgataggggagtaaaatatattcactcacttttggaggatgaaaatagccaataaatacagatgcttttatgatgacttttaatataattgccaataagtatctctgctaaatacaccttaaaattttcagagaaaatacgaaagttgaaggtgagaaacataacgtgggtttgagacagaccttgagacatggggccacaatgttccatgtatctcttttcaaaagttatttgcacagagggaagaatgactcttggggaacaaatcagtgcccaggctcctgaagcagggaaggtttagggtatgatggagaaagagagtttactatgtattcactacctccgtgggccagtcctgtagagttatgggcccttgtgaaaaaaaatttagtatttgggcttttctaatttgtaagtaacataagcaattgatatttctagccacagtttgaaaaataagatacagaatgaaagatatgagccttttacccatctccctatgcttcaatgtagggagaactaaagagaaacttggtcatctgggaatatgtgatgtttcgagtatttcaaactaaatcaaagtggctaagaaaaagaatcattgcagtgaagacactaccagtgaagtaggccttaagttaatttttggacattaataattaaaaaaagaaggccaccatggaagaatatttaaaagacttttaaggctgggcgcggtggctcatgcctgtaatcccagcactttgggaggccaaggcgggcggatcacgaggtcagtagacggagaccatcctggctaacacggtgaaaccccgtctctactaaaaatacaaaaaattagctgggtgtggtggtgagcgcctgtagtcccagctactcgggaggctgaggcagaatgccgtgaacccgggaggcggagcttgcagtgagccgagatagcaccactgcactccagcctgggcgacagagggagactctgcctgaaaaaaggaaaaaaaaaaaaagatttttaaaacacctctggagacagagaaatagctaaaacttgatgggctactaggatcttgattcttgtcactgtcagcaatgtgccagtgaaatatgattattattttgaagtgatctaatttctacctgcagttgaataaggacttaggaattttaatttttcgcagataaatgatagctgcttcctgatatcttaggcacaggattaatatacatatcatttaattaccataataatgttattagtcataattacctatggattacagatgaagaaacaaaggtatatagaaaagttagtaatttttctaggccactcaaatattgaaagtagaagcctacactttaaaacaaaccaaagcttccgcttaaagcaactagaaaaggttctttaaaaagtgccatggcagtgctaaaaacaccagtgaaaaatgacatgattgagacctagataaaaagaaattcgaaggcaatccctatatttggagatgcatgtccctttggggtggcaataaattccgtaagtcgtaactgagaggctaacaacctgaacaccagttttgaaaactttatggatttagtaagacaaaaattgcattctaggattcaccaaaatggcgaactcacatgagttagagatctcaaagaattacaacttttaagaattcaactttagtaagaatgacccagaaatacagaaccttagaaagaagataagtattacttgaaatcctctcaatttccaaagctggaatgcaatactaaccccaggttgctagcaacttacctctctaaataaatgcaaacatattaaatacatcattttgggaggaagaatatatcactctaaacctcaaattttatctgattcatatgtacaacacctgggatgtaatataaataagcaggaaaaaaagtaaaagagaattaactttaagatcttcaactcaagacaaatgtgaaatagaaatagataaaccaaagattcagatgatgaatttgttacagtgattaagctttatatgtttaagtagataaaaaataaaaaaactgagaatttcaacatggaaatctattataattaataactaaatggcaattccataatttaagaatgaaataaaattaagaactcaattatcttaacagcagattaggcatagctaaaaagagaattacttgttcggaaagcaaaccagaagaaaatgtatagaaggcagtatggaaagttgataaaatgaaagatagagaatagacttgatacatcatagtaaacatgcaaaaataaatgcaaaaagaaaaattataagggcagttgatagtaaagtaatttaaaatttttcatagattttatatggactttaagaagattaattttaactactttctgataattaatttttgtaattaatagacataacttaatgtggtgcactggctaattaattcaggaaagtgaggttttgctgatttctacatcagacattctgtctccttttcagtttgtgtagcatactctcaaatggattttagcacttcctttcagtcacactgcatctcctgatttcatttattttccaataaacaacaccctctctacagggtcattcctataagcattcaaaccatgcttttatttgtattgttaaaaccaaaccccccccgccaaaaaaactttctttactctatcacttgtctcagccacctgcccctttctcttaaaagcaaaactttaattacacatacgcacaatgtctaattcctctctgtatatagacagtgcctagcttatgatgatttgacttactattttttgactttctgttgtggaatctgatgcttatgcctgccttatgatgattcaacttactattttttgactttctgatggtttgggctgccatttgtttgttgttgttgttgttaaaaaactgacaatggctggcttaaaataatacagattacatctgttttttctctcagtacagttttcagtacattacatgagatattcaacacttcattataaaatagactttgtattagatgattttgtccaactgtaggctaataatgtaagtgtactcagcatgtttaaggtagagtcggctaaactatgatgtgcagtagcttaggtatactgaatatattttcaactcaggatattttcaacttatgatgagtttatcaagatgtaacctcatcataagttgagcaacatctgtatttactcttgaatccacaccagcctctttcaccactccatcagtaaaatgctcttgtcaaggtcctaatatcctccacagagctaaatccaattaattcatattgagacttttttctctaatgacacgtcccttggtgatattatccagtctaatagtttcagacatagtatagattacattgagcaatttcagtttatatctcgagctatgaattcccctgcactacagactattgggtccaactgcctacttgtcatctccacttggatatctgacattacatctaaatcaaactcttgtcatttccacacaagtttgctctttctgcattcctttcaaacttggttaatagcagctctattcttccaattctcaagatgaaaatctttgctaattactgactccacttctaacttttacatatcatatccatcctgttggccttaccatctaattttatccataattcaaccacaccttaccatgttctctttgactggtctattccaacttactactagtgattgcctttgcctaaagtgctcatggtcctctattcatctcattaactcttactttcattatgatccagatttaagcataattcccccaggaagccttaagtattctctctgattttagaaaatactgctaaaatgtgtctcaagtctgtctttccttggtagcacttgttgcaattgtaactgtcaatttttacaggattggtatatgtctatctgcctcctttgtagggtctactatttaagcaaaaattgtcactgtttcatttgtttaaatagccctaaaagtaatccaaagtatctagataaatatttttgaaataaatatttcaaaaataaatatttttgaaatgaattaactgaatataatgagggagaagtcaagcctcagaatttgatcctccaaaccaaccagtagtcatgctttgagtacatgtttgacactagagaaggtctaacctttctcatttctcatccttgtgcccaagttaggagtgatgctgatgaataataaaaataatattgaaattggcccaattttcccatagagctgatgtttacatttttttgaataagcatagaaattgctcctcctggtcttaaaacttgagacttacatttgtctcatctacgttcctttctcagaaaacctgccatcagttctcccagatagtatcaaggaactgaaatgtaccagatcactacatccagataatgaacaacaaaatcctcatctatcatgattgtccaactgactacacgctttctgttgatcaactcctcttctttacccctccctaattcttgtttttttgtgcatagttacattccttccctattatatagacctccaattttagtcaactggagaggaggtgaaactaatctcctgtctcctggctaacatcacccaaataaagactttctttcctggcaatactcgttgtctcagtgattggctttctgtgaggtgagcaatgggatctaaactgaacccctggtgtttggtaatggtattatagaacaaagatttagaagtagataaaaatcaagatgtagaaatttaaaagagaaacttgagtcatcaaaatcatagtctgaaaattgtcatttaaagatgaaaccagagttgtgaattgaaatgctgtcagtatctttttaaccaggcttgatattgcagtagtgttacattcaggacttacataaattagtgcttattaggggtatctatattcagtgcttgccagttgccagtgataaattatatatcgtttgtacatgaacatagcatatttgagtgtgaagacttaatattgggttatggtggggttggggtggggaaggaggactccattcaatagtgaaatatatgacaaaaattagtgtaattatttgagatttcttaaatctaatctttatacaatttattggttttatctataagatttattttcatcatgcactcattcattttgactaagctttgaaaatgctaaacttgaaattcatggtaattgttataacttcctaaaaattgtctcttctcgtgggtaatagtttatttctttatagatttggcatcagcttatttcaactgaaagagctaaaagaccataatgcagctaattaactcactgatttgtagcttcttaatgacttatttattttaaaggaaactaattaagtgtttcagaatacactgaaaattacttaggaaagacttattagctcctactgtgtcatgctcaagataataaaatgtaaggtaccatgatacaatggatgaggctccagatggctagccaggaagcttgtattttgttcttttctgtcattaactagttgttttgccttgggcaagccagacattttaccaatacatatttttcacagataagtttagtaaaacaaatgatgtgacatacacatatgtttagaaaactgccaaaatcttatgctgaaatttggctttttcattgaataccatgactctttcggtcagggatatttttaattgaaatgaagagaaatccactcaaccttgtttatgtaaaagagcgctgaatggtgatagtagtatcttatgagactcaaatgtagaaaaaacagacaaacttcagcaaagactgagcaccataaaattaagaatctgattgattcatcccagttcatgaattcaactcctggttgaaattgctttagcaaaagaggttcaaaatcactttgcaaacttgtagttgtaggggccttgactgacagacttgtctactagttttccttaaataatttctcattcatgacatttggttttttatagcccaactgctgaatggatatttaaagtagtctggggtttatattgttttgtatttaacagtttggttttggttttggtatactaagcaagattttgaataattcaaaagaaatatatcagtttatataaaactcagtgaaaatttataggatgaaggacttctgaaatagtgctccagagtttcaggcaggaaaatgttgaacagacaggtaaaaagagaaagtttcctagaacctgtgatgggaaagagtacggaaaatacaagagactagaagaatgtcagcatggctggaagagagaaagagagcaccaacctaataacaaatgaggctggagagcactacaagtacctgatcatgtagtgccttacagatcatattatggacatgtatcttcatagccccattaagagacaattctagtggtcaggaagagagttgagggtagtcttggtaattttaatagcagtaggggtggagaagagtggaacaacctaagagacatataattaataaaatccacagaatttggtggtggtttggtactggatgtgaaggagaagaatgtcctcaagattgaagtagtgtcattcatctgggataacacccaaggtttgttgtcccatgtccacagaaaactaggacatggatacaccagaatgaggttaagagtggaaatttaataggcgaaagcaagagaatagctctctgcacagaacgcgcggtcctggagaaaatgtgttactgcttctacagtgaaattcagaaggttatataaatgagcttgatggggtggtgtctgctttacatagggcatgaaagattggtcagaccaggtgtgccatttgcatagggtgcgaagaagctggccaccccaccctaatctttattatgcagatggcttctctacttggctagtgccatgttgcctggttctttactgtacacgtagcgacaaagaaaagtgaagatggagccttcgtgttgaacatacctggcttccagatagccttttctattggcacagctgtcggcattcccctgtgcaagcttccagcttgcttatctatgtttgcagttcgatttttcaggctgctttttgttaaaaaagaaatgatttgggagctgctttttgctaaaagggaagccgtgctgaggactcctttaccctctctatttgcctaaataatttctttctagctcctgtattaggatgagtgtggtggctttaaaattttttctcaaatttttttgcactcctctcttcaaagagtgctgttcaatttccctcctcttgaaatttggctgggtaaagtgacttgattgtgcatgaattttgtggttaggtcataaaatgcattgtaacttccatcttgcactcttttggatcactgactctgggaagctaatcatcatgttgtgagaacactcaagaagctacaagggagaaaccaagggcttctaccagtaggcttcattgacttcctgcccatttcactgagccatcttggaatcagcttctctatttcagtcaagacttcctctgacttgactgagatcttgacataaacctcatgaaagattcagagctaggacacctacttaagcagctcctgaattcctgactcacagaaactttgaggcttacaggtatttattgttgttttaagccacttaaatatcagggtaataaaaagtattttttaccaagaagtttctgcataataataaaacaggttgatatagaactcagtaaattttcaataaaccataacatttattatttttatggatattatagaagttgggtcttcaagaggatagtttaaatgaggaaatgtttcagtgatgctatttgacaaaggcagtgattcttcaactcttcaaacttttgtgtaattccagagagcaataaaaacacccttgatttgatttagagtatcactgtctctttgggaagggatcatgtggagcctttgtccggatattacttcaatgtcctctcagagaaaagaggtcttccttgaaaagatcaggtgaaaggtatagcaaagacttttcctgaagcttataactcctgttcttgttccttgtaaacatttttgataaatcacttttttaaatctgggatgttcaatattgttaattagcatttaaaataattaagcttaaaattataaacttaaatctgcagctttacacacacatctcattatactaatcgctgcatgcgtaagactttcaaaaaaacaaggtgtaattccccaaaacaactaaaaagcaggttttgaaaatctaagaggaaaccaaacaacaaaatttcaacattcttatagaagcagaatgttctataagacattgcagaatatttgtgcagattgttaagataagacaaagcagaatatttgttcccccatattgtatttcatatacataaaagttagccctctgtatctgtgtcaagttctgcatctgtggattcaaaaaaccagacattgaaaatattcagaaaaagaggatggttgtgtctgtactgaatatgtaaaggctttatttccttgtcgttatttcctaaacaatagagtataacaactatttaaatggcatttaccttgtgttaggtattatcagtaatctagagatgatttaaggtatgtgagaagatatgggtaggttatgtggaaatacgactttattttatataagggatttgaacatcagtgaattttggtatcctcgggagtcctggaatcaatcccttgtggatacaaagggatgactgtatatgtatctgtatatatttctatagacacccatatacatacaaaacacatattcttatattcatttagttgtatatatgtggtaaaataaagttatggaagactgtatatgcaatagatgaaataccaataaagtctctgtaactaaggaatataccttctgttggaagaaacagaaaataaacaaaataaacatatacataatcaagacagttagagactgctctatgttctcagaagaaaatagccagtatgatgaaatagaaaagacagtctatcttgaataggatgcttgaatagacttagaaagtctttactgagctgagtgtgaagcagacaaaagaagatacagagaacaactacttcaaacttacggtgttgtagcaataatcaatctactggaaaataataacataaacttggtctcttataccatgaaaataacttacagataaattaaatctctaaatatatgtaaatttttaaataaaacattcaaaaatagttcaagagtaagcacatttctattttctttcccttgcagtgttcattaaaggactactaaatgactaaacacagattcactttcaaagacaacaggaaggagataacagcaaacgagaaattcctacaagttttacaagtttctgggagatgaaaaagaaataatctataaagagatttatatgtatctatccagaaaattttcagaaatgataaaaacaggtattgtcaaagttaaatgagcctatttgagatcaaaggaggttaagcttaaatagagaattgtctagacctatttttgtaaacctgccaaaaattatgaagagaagattctgaaagatttcctgaatgaatattttgaaagaaaaagtaaaacacaaaacagtgagaccacttttaaattttcatttatggagcctacaagataaaaagataaagcctttgaaaattctgggtgagcattattttcattcagtgttttcaatccagttttccagccaatctatgaatcagaagtaactaagcagccataatacatggaatcaaatactctacctgcataaatgctctcctggaaaaatctttgagaaaataccatagcaaaatgaggaaatagacaagaaatagaccaagaatcctaggagctgatccaacttagaaagtagtgatgtgatttcctcaaatgaaatccatgcagaagatcttagaaaacacagatacagttttgatcagaagaagagagaactctaggatggtcgctgtgctgtggagtgcagtgaagtatggaatgtattgcaaagaggacatcataggtttgagagtgggaggaagaaaataaatatttgaaaaagcacttaaagccagaagaaaacaagtatggaattaaggaaaaacaaaaggtgaaccaaaaataatataagggtattattcagatgtatggatatacagtcatgcaccacgtaacgacattttggccaatgtcagactgcatgcagaattgtgatcccagaggattataatgaagctgaaaaattcctattgcctagtgatgtcatacccatggtaatatcatagggcaatagattactcatgtgcttgttgtgatgctggtataaacaaacctacagcattgccagtcatataaaagtataccacatacaattatgtacagtacataatacttggataatgataataaatgttactggtttatatatttaccctactatacttttaatctttattttagactgcatgcgttctagttagatttttcaaagttagctgtaaaatatcctcaggcaggtccttcaggaggtattccagaagaaggcgttgctattgcaggagataacagttccacacatgttatccctgaagactttccatgggacaagatgtggaggtggaagatggtgatagtgataatcctgattctctgtaggcacaggctaatgtgtgtgcttgtgtcttagtttttaacaaaaaaaaaatttaaatgtgaaaaaaatttaaacctagacaaaagcttatagaataaagatataaagaatacattttataagctgtaaaatgtcctttaagctaagcattgttatcaaagagtcaaaaatttaaaaaaattgaaagtttataaagtaagagttaccgtaagaaagaaaatattttttaatttagtgtagcctaagggcacagtgtttaaaaattcgacactagtgtacagtaatgtcctaggccttcacattcactcaccactcactcactgactcacttaatactgcaagcgccattcatcgtaagtgctctatacaggcaaatcatttgcttttacctttagcaaacgtagttttactgtatcatttctatgtttagatatgtttagacatatgtatacaattgtgttacaattgcctacagtatttaatactgtacatgctgtacaggtttgcagcctgggagccataggctgtaccacatagccttggtgtgcagtaggctattccatctaggtttgtgtaagtacactctatgatgttcatacaataactgtatcacctaacaatgtatttctcaaaacttttccctgctgttaagcaacaaacggctgtagtcataatagtaagaaaaatgtgaacatttaaaaatgattgcttagctgggtgctgtgactcacacctgtaatctcagcactttgggaagccaaagcaggtggatcactgaaggtcaggagtttgagaccagcctggacaacatggcgaaaccccatctctactaaaaatacaaaaatgagccaggtatggtggcacatgcctctaatcccagctacttgggaggctgaggtaagataatcgtttgaacccaggaggcagaggttgcaatgaaccaagattgtgccgctgcactccagcctgggtgacagagtgacactgtgtctcaaaattaattaattaaaaaataaaataaaaatgattgcttttaggaagcataactcagtataagggaggtaggactaaagaatgctatgaacagcattagagtgctatcctcaccatttgattttttaatccatatgcaaattttactttaaaaaataattcaaagtaaaggattagagatatagaagaaattaagacttttatagaagagaattttataaataagacaaaataaaaagccttaaagaaaaggctgatttatttagtacccacacttactcattttcatcttcaaataggttttgaaaatgtacaatgtgtcgagcactgtctgaggactctggattctgcaataaataaaatggaacagaatctttggtctcatggagtttacattctagcagaatggaacattataaaccagaaatatgagaaattggtaaattacatgctattttggaagaaaggagcagttagagaagaacagagcaaaggacaatcagaagtgagaggaaaggaaacaaaagatgctggactagaaacctcctcaacagaatattcacttctctattctgtggcagaatggattagcggtggggagaggcaagaacaaattctcaaggcaactctctccccttcaaagtaaaggaaacacatggaatggataagtagtattaatcccctaattggaacatttttcttaaatatatatatattatatacatatgtatttatttgtggtcacatatatttgtagaaatatataaaatataatctggaaagaaacatattaaatgatttcagtcattatctccaagaagggaactaagacagtgttggcaaccaagggaaacttttcatttatccaaaatatttggatttttatattgaagacataattatgtattacctaagtaattgtaagtgaaattaaatccacataaagactttgaaatccattttaattaaatggctataatgattagagtcaaaattataaatgcaagtttgtggttatatatcaattaccacagtagcagcttcatacacaagctttaaaaaaatgccagttacattctaaatccctgtagcagcatttcagggaaatagtttgtcaatattactttcctttgtcaaatccgtgaaatagcagttgatttcttaaaataaatctcaagctataaaatgtttctcataggtattgttgctcctagcttccttctgggaagggatagtctttcttttctctctcattcttttcatatgcaaaaagacttcctccctaagcctgattctagacaattcatctttacagtttgtttttgaaactgttttattctagttgtgttcattcaccacacacataacacacacacacacacagagagatgcatgcactcacacagacacagacacacacacagacagcatgcacaaggtacttccccgcctgttttttttttttttttttaatgaaaaataaacagggaatttgctctgactctagcctagagtgtgctgttggataacaaacttaataaaaacgttcagctaccaataaaatcaaaatttggaaggtaaaattttcttggaatagcagatgttaccttttctttagtcagaaaaaggtcagggcacccccagagtcacaagagtaattattcaaaatccaggatgtggcctgatctctgttaatttgactgtgcatttttgccaaagggaattttatcaattcttttgcttaaatgtcatgtcctccacattgcctttcttggcttagctgagccagaaatgatccctcctccactaaattcttataggccataggttatatcacaaatgtggttctcattcactggttttcaatgttgatatgtaatacttacaagtcataattctctttactagcctggaaacttaaaggctaagggcagcaatcatgtcatatgacacatatggtgaattagaaaaacaaataacacaactatgttgctttgctgtaatttctatagtcctctagaactcagtttgataacgggtggatcatttgaaactcaattcaagaacattttcttccttatattctaaatatacctcgagcagtttaacttaccaaaaggtcactgagcatgatttcaggtacatttttctagtcataatttcaaaatgattacataaaatcaatgtgaaaaaagttgatcaagaattgagattatcttctaaatcttatttggtaaaatacttcctagaactttaaaataagcacaaagcatgtttaaaataaaaacactatatacattttattttaatctatgtgtattatcagaaaaatactacaaaaatactgggaaaaagttatttcaccaatcagaaataagcaatactgacagaaattaccattttacttgggatattttaagttatagatttacaaaggaaaagatacagcaatagtactaatgaaatgcatttttataaatcttcaaatcaataagattcaggacataaaagcatgatattttgaagcaccaatctctagagtctccagacttaaaaacagatgtacacagatattgcagtgaaatcattctaaatttatttttataaatagtattgaaccagcagagtagggactcattcagattatggtagatattcatgcttgtataactacagatgtttatgttaatatcccctttaaatggaaggcattctatcttaagtatattcaagacagattgggcctttttattcctgtagtgcaagaagccctacctctgcctggagagagaaaatggcatagaacaaaggagaaaattaaacaataaagcagaaaaaaagagtctataattaaaagtggtaaggacaggtaaatatagcactaggaatggtgtcattcaatttcactctactgaatattacgctatacctcaaggtttttatagaattatattctttttaaaaagtaagagagagcaaagtttagcaagatgccatcactgatgttaacattattcttaagactaatactcagtttatacttaaagctaatattctaggttacccactctctcacctttctctccttttctcacccttcctccgtctttttttcctacctttcttctatctatatgcctaaactattataggcaaaacattaacagttccccaggaaacaaaagggttcagacagcctctaaattatagaagttatttcctgtggcaataagagcacacgcgttcctttaatcaagcataacaaaacccctagagactgtgctttgtacaaaaaggctagctattttcaacatgtaaagaaaatggttcagaaatataagtgaaaaatataagccaacactgccaaccttcatgctcatatatagaagaattttttaaaagagtcaaatgtctgaatttgtttcagtctcatattttccaatgaaaagattaaatattgtcctataattctaattaaatgagtcatattttaccttttacagagtgatgagatgattattttttctctagaaaagtctaatacagtgctcctttggaaaaataaacagagaattttaattaggtgatgtgggtcctatctctgactttgccaccaaaattagtgcagccttaataaataaagatcattccttggcttcattcacttcctcttcagagcaatagaaatgtctgctgcaatgaggctggactgaatcctctatgaaaactacagcgtagccacaccacagtaccagaaataacacagacttggctctattctgtgttgcctcgtaaccagttgcatcagcctacactggtctgtttcattgttcatctttatcatacttgagacttcccacttcaaagatataattgtgcattcaactgatgaattatgctgaattatgaaattacaacctccaaatctatagcctaatatattctgcctctattctaacctctttctatttagttccaaagacttagcccttttctgatttaaaatctatccttcaactattgctattaaaacttttctttgtcatctttatttaatgactttgccctatctcttctgtatccctcttgtctctttctaagtatttccaaatccgttgatgtcttttctccagactataaacaagctcacatcttctgaaacagatgccttggcgggactcacaaaggggttagctcgtttactcagcccacagctctcaaaccctcacgggaaggggagcacacaggtgagagtctgcaggaatcaggacaaaggcttctgggcgctggcaggagtagaactctgtgtggctctgcagcagcatcaagggggggtatccatgaccccagagctccaaagagcatgtattacagtgtgctcttttagctttgctgtccatggctggcttaagtgtttaacagctcaatagggggtcagggtgacagccttttgcacttgccttcttagtacctgagttcttgatggcatccaggaagaatcaggttgcatgaatgaattgaagggtggtgaatgtagaggattatattgattagtggaaatggctctcagcaggatgcggagctggaaaggggatgaagtgggaaggcagtcttcccctggagtttggccatccctgagcgaaattttcttcaaagttccactgtccaagcagtccctctgaagtcaagctgcttctctctgatgtccagctgcttcttctcctctctctttttctgccactctgccactctgccagtggagcttggaaagcttgatgtattagttcattttcatgctgatcataaagacataactgagactgggcaatttacaaaagaaagagttttaataggcttacagttgcatgtggctgaggagtcctcacaatcatggcaaaggagcaagtcatgtcttacatagattgcagcagacaaagagagagagcttgtgcagggaaattccccttttaaaaccatcagatctgatgagatttattcactgtcacaagaacagcatgggaaagacctgcccccatgattcaattacctcccaccatgtccctcccacaacatgtgggaattcaagatgtgatttgggtggggacagagacaaaccatatgattccatccccaacctcatccaaatctcatgtcctcagatttcaaaaccaatcatgccttcccaagagtccccccaaagtcttaactcatttcagcattagctcagaagtccacagtctaaagtctcataagtgacaaggcatgtcccttctgcccaggagcctgtaaaatcaaaagcaagctagttacttcctagatgcaatggggttataggcactgggtaaatacagccattccaaatggaagaaattgagcaaaacaaaaaggctagaggccccatacaagtccaaatgcagcagggcaatcaaacctcaaagctccaagatgatctcctttgactccatgtctcacatccatgtcatgcttatgcaagaggtgggctcccatggccttgagcagctccacattgtggctttgtgggtatagccccactcctggctgttttcatgggctggcattgagtgtctctagcttttccaggtgctcagagcaagctgtcagtggatctgctattctgaggtctggaagatggtggccctcttctcatagctccactaggtgatgtctcagtagggactctgcgtgggggctcccacttcacatttcccttctgcactgccctagcagaagttccccatgagggctccgcacctgcagcaaacttctgcctcatcatccaggcatttccatacatcctctgaaatctgggtggaggttcccaaacatcagttcttgacttgcgtgcacccacatgctcaacaccacatggaagttgccaaggctggtggcttccaccctctgaaacaacagcccaagctgtaccttggcccattttagtaatggctggaattgttgggatgcagggcaccaagtccctaggctgcacacagaaaagggatcctgggctgaaccacaaaaacattgtttcctcctaaacctccagacctgtgatgggagggtctgccacaaagttctctgacttgccctggagacattttccccattatcttggtgactaacatttggcttcccattacttatgtaaatttctgcagccagcttgaatttctcctcagaaaatgggagtttcttttccgtggcatcatcaggctacaaattttctgaacttttatgttgtctcccttttaaaaatgagtgcacgtgggaattcaagatgagatttgggtagggacacagccaaaccatatcccttgataaaatgcacattctgattcagtgagtatgtggtggaagacagtgtttgtagttctaataagcttcctaaaggtccacacattgaatagctaggtccatgatgggggaggacttctcctcatctgcatgccccagtgggttataggtttgctgtgttttccatagctcagtcttcagtgtgtgagctggggactggcacagccggatcccaaaggtcagggatctctgtgagtcaccaggtttatttaccccaactggatgaaacgtccaagtgtgcttctcaacaataaaaaatattggaaagccctgccccagaattctagccatcaaatctcacctatttccagttctgtatatttattaaatggatatctcataggcatcacgttcactatacatatctagaacttaactcacgatacttgtccataggactgttccttttcttgtatattctatttttgtcctggcactataattctccaagttactaaaagaataaatatgattatcttacattattctctctttttctcacatccaatcaatggacaagtggttttttttttttcttggtcatttctaattgtgtttccttctctctgtttttgaaatgtgctatagcattgatcacatactatgctctctgaagccagttttgcccctcttcactgatcaacacattttcttcacagttatccatattatttctctctttttttaatttgtgttcccaaattcttggcatgctttatattttaatttttaattttaattcttgtgggtacatagcaggtatatatatttatggtgtgcatgagattttttgatacaggcatgtgatatgtaataatatcatgtaaaatggggtatccacccctcaactatttccatattacttctttagtgatatttctgagacgatctgaccatgctcctttcctacctgtcacagttctttttgcttcagtgaaggtctgagctccacaaggcagaatgcatctggagcctctggacatcctttagagatgcttccaagaagttcagcatgccacttctatttacaacttcttggccagaacttggccacagaggcacacaagcctgccaggaaaactgcaaaatctttaacatcttggaagtgtctttaaagagaagcctcttcgttctgatggctaaaaagaagccagaatgaatgaaagcagagcatctatcttcgatctcaaagaagcaatcccgcgttaagggtggcaaaacaagagagaaggattggcaacctccattccagccttgagctgttcacttgcatagtttttcttttcctttctttcttttactcttgaaagggagaaaaatctttcttaaaccaatgctattgtgcactttttgtcactcacaaatgaaactaatctgtactaaaacaacaataagaggctggtctgttcatcccttatttactttcttgccgttcaacagccctcacttctactatacaatgaattttagaaacaaagatagataatctggcattaaggttactaatatatatacttttttgagatggagtcttgctctgttgcccaggctggagtgcagtgtcactatctcggctcactgcaacatccacctcctggttcaagcaattctcctgcctcagcctccctagtagctgggattaaaggtgtgcaccacaacacccagctaatttttgtatttttagtagagatggggtttcgtcatgttggccagtctggtcttgaacgcctgacctctaatgatccacccacctcagcctcccaaagtgctgggattacaggtgtgagccagtgcgcctgaccaaggttaccaatatttaattaaatatgaaattatagctataatgctaagtatatattttctgctaaagagagattatcagattttgaccatgttagtttttaaaaattgtagttggctagaacagctctacactttacattttaaaagtagcatattaaatataatcactcagtctatagaaaagtcactcagttcttcaaagaaagaatcaagatctaatcctgagtcttatttctccaaatttattcttattttcacatggcatacaagtgaatgaggagaggcaatagaattcaaggacagttaatttagaaaatatttaaaataaatgagctatttcttatagaggcatatatcttggctttttactactatgtttttgaaatttaattctgatttttctctaggaatttgaatttttttcatatcaagcttttccagtgtaatatttgatgtgagattatatttatgataactatacatatacccacagggaatgatatgtactttgcccttttgaaatagagcaaaattttagattcacagttatcacttagggggaaatatttaggctacacataaaacctaattctccactatagtctcaggaggcaccagcaaaggtctgcagcagagtcaatgactttgatgattctcactctatttaagatttgcaggaagagataccctaaatttcagagatttaaggggaaaaatattttagaatcttttcaactgttttaaggtctttacaaagaaacaacataaagcagaaggaagatttctaatagttctatctttataatcctctgctgcttctattcttaccaataaataaaccaggaggcaagttaaggactcagaggtccatttatttgtgctagacagtaggatacagaaaaaaagaaaagtctcttggtatcttaatagactaaatgtaagtcacttcttataaaggaatgatttaataatgtggaaaatagttaatgcatattagattgttttgttattaataagaaagtaatttacaaaggcagattgtctctaagttctttgggttaggatttcattacacacttccatctttatcacttatcagaaatgtaatcacttgtttataaaatcaagaaaacttgtacgtctcttttttattggatgtttgtcttgtttaacctactaataattaagtttccctttaaacttctgataagtagaacaaactgattttaaatgatggaaattaacaaaaacatgcctatgttgacaccaactggacaagtgaatatagagtagcttattagaatatgttcttccctaacagtcaagtgctgacaatgaaaaattttgtaacagagaaaattattatttgaataaacatttgctgatattttataactctcttgaagagtcatacagattttccccagcagctagtcctaacacaacaatacagcgtggatttatttgaaaagaaaacttgagggcccatgtggaaatatctccatgaagtttgccatattctctattccacatggaaactgtggcctgtgccaacagtgcttttcctgaccattcaaattccatcctcttttctgcccaaattctatcacctgctcaagattcacttaatatttcctccttctttataaagaatttatactcctttccattccagaaaaaaatgttttttctcaatatttatcattattactatttcgggtagttattcataattacattttcagttattttcagcaaagaatcatcactcatctaccttttatagagactcacaggattaatacataaatgtatgtaaacaaagagacaaatgttctgtggtaccaatggttctacatctatctagagaattggaaacttattagagattctgatcccagaactctgataggtgcaatagcagaaattcaagtatgataccttgagaatatgcatcatttatttgattaatatttagcattgtcatttagttatgctttctcttttcagtgcaaatatcttttttaaactagatgattacatcatacattgatttaaagatacacctcatatatgaaatagcaattttctacaactattatggtatgaagcgttattttagtgaaaaatatttaaaagagaaaccatcacacatgaaagctgattactgctgaaaagagtagagttgggaattgtttccaaataagaacaagtaaggcataactgagtaagaaaatgaacatttttagatatttttttctagacatttttccctgaaaaggagagataaggggcaagtggaaaatatattaccacagacacataaaattaggaataaagaaaaataagctgcaccaaattcctcgtcaaatgttcccctgaatgttagaagcgcagaatgataacatagtagttttggttatgcctggagttatttatctgaaattgttaatgtgctttagaaaagaagaaatagtgcttcatgacagaaattagtgagctctttcagcatgctagacactcttttaagcccagcagagagaactgggaatgtattttggtccctgccctcaaaaacttcacagtttgagctagacagagaactcagacagtggcaacagcgctgggatatgtggcactggcacacagaggaagcatcctcacctagactttagggagaccagaggcttcttagagaatgtgaaatgagttaaacaggaattagccaggcaaagagatgggattcacatttttttcccagtcatttgatgcaggacatttgggtagtcatttcactgagtctcaaataacttatcttcttcaggcttccacctaaagtattagatgaccaatccgacacactccctccaccacccacagaaaaggcaaacattatttgctagtgatttcctcacaccctactgctatagtaattacatctattttattttcattagtagtattttacttgttgccacagttagctgacaatcattttttttttaaatttcatagtaacattactgtcagatttttgtacatatttcctaacttctgaaaaggagaacatccagagctaatatcaggaccaactgttgaaatcttgctttataactaaaagttaactttaagaaggaatgtaaactttttacatgtatttgacattaaaaacaaagtcaacagagtctaaacctagtcaacagtgtatagaaaaacaaatgacatagaaatgaaaatatttccaatattatttttaaagttatttgaataaaattatgatatgacgttagtaagagcagcagtgtcatggagaaagtccagtggcttcttggaactatatgcatttatggaaaaatatactgctaaagttctctaatgcttttaaggctaacttattttacagagtgttttaattgtttattgtaaaaagctgcaaagccctagtaaaattcaaaataaataaatacttttttatggttttatttctatgtcatgacccaaaattgtaaattatatgaccctagtcaaagtagcatcataaaagcatagcaaccattataacaaggagtggtatcatcccaaggtgggtgggcagaagttttttctcagggggataaaaagcctttttatttttatttttaaaataaatatatagagagagtacataagaaaatacatgatgtatctgtggtattacaatttcttggaagtcagttacaaaaaatgtctacaaaaggtgctttaagaggcaataatgaaaaaagttgagaaatatacattacattacacaatacaaatgcattacacaatacaaattcggtttttcatggggcaaagaaccaaacccttctcttttccactagatgctgccaatttgtatctgttttacagcctcttcttgaagtagttaatatcttctaaggagattgtttgatcctataaactttatgatctcttgaacacaatacttcctttttctccacttgataacacaactaaatagaattcaaatctaaaatcttagaaagatgtgacagacaggcagatgtcatctcagtgcttatatattatttgttgagcatgcatgacattgaattaaacattatggaggtaaaacaaagaccagaaatgattctatccccatgggagttaaaatttagatacacagagacaacttgcatgaaaatctaaaacacaaattggaaatggatatcacaggttctcctctccacagtgatacagtgttaaaagttggggttttgcttccccagtacttaacacactgctttggatgtagccattgctccatacattattatagaagttatagagatattcaggtagaatgccatgggctctctgaaactagagaatccaaacttcatgcatggagcacctccatggacattatcatttaaaatcatggctcaaatataggcccaatttttatgaacaggaaggtcatcataagtggagaaaatccccaaagaacacagaaacaaacatttatggaagcacatataggaaaaaatagttcattttgtctaggagaaaacagaggacattttattttttactaattaaaaacaataaatattttccttctgagtaaacaagtccttatcactaggaattttaaagattaagggatgaccacctgttgaagatgttcagagattctaaaatttaggtaggatactggatggaccagttacctccattgtaagcccaatcattctatgttggcaatggttgtataatattatcagaaatatatcagggtttggccataattcctgattggttatggcaaatgtttgtatgtactcatggagaattcttcatcgcttacatcggaaatgcttccattcagtaagctttttccagagacctttaaattgtatgctattcctaattgtaccattgaggtgattgcttctgtgcatcacgttgcctacgaggtactagtaatacttcctcctaaaagcatctctagtaaggagattctgaaaaaatttcagaaatacattatgatggagctgcattgttttaccactgtttcctcttctgataacatctcaggatttaaaactccatttattgaaaatgtgtgttgttgccatgcagttgttagaatagcttcatttactgttactgaacagctcattccatatatacactgtttgttgctaaacagttggttctgtctttgaatttctgcctgcactccagaaccagttctctggagttacttgtctcttttggccatttccccaagcaaaataaagccacaggctgtaccatccacctaataaaaaaacaaaaaactaaaactcaaaaaaaaaatgtatttccacatatacatgtacatacatatgaatttgaggcgggtggaccgcgaggtcaggagatagagaccatcctggctaacatagtgaaaacctctctctaccaaaaatacaaaaaatttagctgggcgtggtggcatgttcctgtagtcccagctactcaggaggctgaggcagaagaattgcttgaacctgggaggcagaagttgcagtgagccgagattgcaccactgcactccagcctgggcaacagagcgagactctgtctcaaaaaaagaaaaaaaaagaatttattttctataagtactattaatgcaagtatataaataatcctgtggaaaagggtaggagacaagtttggtgggcaaattaaggaggctttgctagatatgtttcatgatataaggaaaagtagatgatctaccttctccaaaataattccctgaaaatgtcctgagaaaacttgagtaaagtatgtcatctgtaaatatggactagtttattagattagctgaaattagagaaatgctaatgttaaggtcctcttgataagtgatagaaagatattaatatatgctattaataataactggtccttgagataaatagcataaaactgtgataaatctgcaacttcatcacttggttctaataagcctcatctctacagctgagctcagagatctctgagtacttttccatgttctgttccaagtgttctatcctcatcgttgacaaatgtattttctattctttctttgcaccacagtatactcacctttataaccttttgtaaatctgttgtctggcaattaaatctatgcaaatacctgaattcctagctgaggccaggaaacctagctcttctgcaagcatcttaacctcaaaataccccgaaccaaattcaatgtcctcttttcctccaactatccaaatcctctactatatttcagtatttcttttaagaaactatattttgaagaaaaattctcacatggtttccaacttctaaaacaatcagattaaacttttattctagtagtgtgtcattgtttctttacatagctcttaaataattgctatcaccaatcctatgactaatagtaattttgaggtaaacactacctctgaagaagaaccgatagggatattttgagtcaagttataaaactattcctgtaatgatgactactcagttataattaaattacttctttctaaattttagccatattccatcgtgaagcaatgctgtgactcctccatattcttgtagttttattaatgtaactagctcaatagttgttgttagtagaatataattttaaatcatgaactgtaaattcttcaactgaatttgacagtcaccttttcccaatcacatactatatatctgtatcattcgttttgcatagaatattctctttatatatcattttgccccttgaacaaatatcttacaaggcccaccacaagtaccaaggtttcttgatagttgcgcttccttatattccctaaaatattgctatctgtacttttttcttttgatgtttgacccttttccgtttattctagactctaagttgctaaatggaaaaggtgacatttgttcaatcatccaaagctaaattgtgcttagcacaatttgtgcacagaatttcgtgaataaatcttgttaaattgcttaatcttacatagtaaacacataattgctgattgacttgcctcagtacacagttgtgtgtttaagggaagaaaaactatatagaagaggaaatatttttcaagatgttctttcaattggcagggcaaattgcttgaggcattgactggactatgattcttctatacctgggacaatttattgctattttcagggaaaaagggaaggataatgttatatatagcaaagatttttttaaaactatacagaatcttgctacacctccatgtagtaaatcataataatagtaaaattgtattcctagaaatatagttttcttcaatatcttacatagaaaaatagagacaacattaaaaaggattcctctcatcctccaaaacataccaaaagcaaaaccagtaagctctgtgctaagatattttactaaggctttgaagtaaaccaagaaaatattacattttttattattatgacatctgaaattcacacattcaagttttgacacgatgtgccctaatttattcaagtagcaatactgtgttgatatcaacttgtaaagatgaaaaattaaatgatatggcaagaaagtaatcaacttaaatgaaatattttctgttgcttccctgcttttggaagttgttctgcaagctcttcataatcatcacttatctgcatttcaaagaaagctgaacactgatgttttgttctttattttattaatatgataactaaaatccaaaagccatagaaaaattattacataaaatagcaatatccaaaacaagtatgaaagttttaaaaacttttttgtaaatattttgtaaatttttttctgctgcttttgccttaataatgcttatttactaaagtatagatgatactttagtgcttttatgtttttgaaagcactaaagtttcatctgtaggtttgtaaaaatatactagaaatactaaaaatttgtatagtacgataacattacactgatcaaattgtgtactagtaagcaacagaaactcttatacattactgatataagtgtaaaaacataaaactacataggaatactggcagtatctactaaagttaaacacacccatgcctgtgctatgcttagcaattccccttctagagaaagtcttggacctcaacatcatgatcccaaaatgaatacatgtattcaccacaaaagatgttcaatgatattcataacagtagtaacaaaccctaagaaatacccaaatacccatcaacaggacaatagataagttaattttgatgtattcatataatggcatatgatacaacaatgagaatgaataagctattgctacatgcaacaagatggataaatcatataaacataatgcttataaaaataaagcagactcagagtaattatataaagttctaaaatggaaaagatatacttattatataagtcaggagagtgattacctttggccaaggtagtgccttggaaaggattatggtggaggaagagggtggggtgagtgcttctgtgacagtcacacttctacttgctgaactgtagtctcttcacttgggtgtgttccctttgtaaaactttatctagagggaaatgtattatttgtgcacttttctttgtgtatgttgtatctcaataaaaattttaaaaaaatcttcaaagcctatgacataaaaagtctgtactagtgaattatttacttataaatatctgtggtttctggttgttgttgttgcctccaaattgccctggtaagctgttttgaaatttaaaaatatgttaagaattaatgccaatactttcttttgttttcatcttttttcttgtttcctttgtgctcaatacatcagggctagaattagagaataaagaatcatttccaggaagacatttattttacaaaatatttccagtagagggagcttcctttttttttttttttctataggaaatcctcttttgggggtcatcactaaaagtgaaaatgcttaattttttacatataattaaagttcttcatagagtgataacctactctcatctaagactagtcatggatagagaaaaatttatttgatttatgaatggagaaagaaaaacttgatgaagaatataagttatgaagtaaacttttgtatgttgtatgtcttttcaaagaagtacatttttgggcttctcataaaatttatttctaattaaaattatttaacattaaaaaagataaattcttataatcacaattatccatttgaaatactttttcataacttttaacaaaattggacaaaagtcagagaatctagtgatgaagattatttatctcagaacatgttttaacaaatatcatagtgattgccattatacaaatttaacctcattgaccaaaacattttagtttctgactttagcttcctaaatctaagtatctatcaactaagctaatctgatttctttgaaaaaaatgtattttaccatctaagccattaagaaatatagagaaataatcaatttatattttaacattaagtttgtactcctttacataataatttcagaaatataaaagctccatatacttggctttaattattacaaatcaaatttctgacaataataaagtcacaaaaattactagatcatatcaagatgatttttattgaaaatactttggttaaaaatagttcaacttcttattttgggaaaaaatcaataatttcagaaataataaccatcacagtttctattatatataggcaaatgaaaataatataactttctataaggtagtttgagatacactattggtttttataaggtagcccaaagatgaaaaatcgacatagcaataaagaatatttaaatacttcaagtagaaatcagtatgcatataacttagttactctagttattggacttcaatcctcctttgaaaaccttgcaagccataaaaatggaaatcctatggtaattaattgtaacagtaaaattaaatttatattggtgggtcaaaattctatatgagcagtaccttatttttacacattcattaagaacggggtaaaattatctgatcctttgtctagctctcttatactctttaaattatttttttaagcctaccaaatatgacaggatcatgataagaaaatgacatgtcatagaacaatttcatagtttaatggctttgttataatattactttactcaagaagattattcctgacatagaacatatctaataatctatttatgattttgccttcatgtattacctgagctaggtcattagaaaatagtacttgcaaggcccttattttgattcatttaacttaacctctgaatatagcaacaacatttggagtttctctcatcagtaaatgactatggtctgtatttctgcattaaaaaaagtaatgtctcgtttctaaatactaaatgttttgtaactttcaaaaaaagagtaacacccaaattatataattcacttagaaaacgggaactttaaaagcaatttgagaaggaaaacgtaggcttttaaaataatttttttttctcagctgcaaataacgcaagatgccagttactaaaatgcactaatcaatgaaaaagcaaatgagtaggtctcagtagatagactgctaaataatttagacagaaaacaatacgattaaattgattgtttcaacaagtcaatatagaattgcaaatttcccggtctcatcaataacaagtggttgcaacgtaatgcacaggcttaatgagttctccgactgttaaatccaagcgaactcacctgagtaacagtgctgcttcccagaagtaaaatcccgaaactaatgtccgaaagtgtctcacgtgggccatgatacggagagatattcacgatcctgaaaatagtcttatccaaggcatggggaaccagaaagacagaatgaaaatgtacaatctaaccccgcatggtgttggtgtagactgatgcttgggaagcttcagcaccttagacagctccccgcagtatgcggaccccttctcagcattgagcagaagtggagagtcacagtgttataaatgtgcaggtgatttttacagtgaaattacaaaaatgagtgagatgaaatgtctgaagtgcctaggtgctgggcaacagttctctaaagctccagcagcaaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccctttagtattcccttccgggaaaaggcacactttaggtcttctcggatgtgacactgtctgttacactctacaccgaaatacaagagtcagcagtaaacccagaccctggcggagggctggggaagagaagacaatgtggtgcgtgaacgcccgtggaacggaagaaccagctgcttctagaatcctctcaagcctggccagcttctggccaggaagcgttgttgactggatttaagttgggtttccttaagtaatagtaagggttctaaaaagatgaaggtgtgaagtctaaagagatggctgctagagacgcaaggcttcccaccattttttttttttttggtctttcccgttttacatcttcacagtaagtttaagtgagaagaacagctagatcacatggtactataaggtccatcttttctccgtcatgtcagctttctgtccttctctttctctattcttttccccctctccttctctgtccctgttttcctcccctcccacatttatttactttgggttttggatggaagactggaaaagaaaagtgtgtgtgtgtgtgtgtgtgtgtgtgtgtgtgtgttgtgttgtttatgtatttcaaagtaatagaagttttttaaaaattaaaacttctttgatctttatagtggctcttatttactatcagccatgatcaaatgttcattccttgaatcttagattttccccaaaacttcctcagatatttattctgaaatccctactttcatctcttaacttagtctaatgacatgtcaaaaatgattcctcatcttgacacgttggttattcctgaaattctctgtttaactggaaagcataagtcaccaccttccaaccctctcatatgaaaaatctctctctctacactttagtaaaaaagttttatttacattcagtgacaataaagagtttcctggatttatttctagatgtttttattatacttgtctcttttcacatagtggttttctgatttaaatcataaactgccagaagtttcataagggacaccattgattctgcccaggaatatttgtacctggagaagattcataccatttttatcaacttaattattcacgatgaatcttttgaaatctcactaagcacaaaagctttttagttggcgattctttgaatagcagtaataattgtttaaaaacgtacgcattaaaaaacttcaaaactttatttcaagaatacgtggattccttgctctgcttaaccactgactgggtactttgagaaaaggtatcctctttaaaaaatatctttatatatatatatatatttaaagtatatttattgagaaaattagattaaatgatcttgcagatttattctctggcttgatggagacaatgtatgtttaagtcagtaaattaatagataatattaaaactctctttagagtaatctggaaaattaaattacacaatggcttaaaagccaggataattttaactatttcaacttgtagttaacataaaacatagaaatatactttataaaattagtacggatatgaaattagtatggatctaatcctttttaaatataaagttcatatgaaagaatggctggaatcctcgtaatactcatttttcataacaccataattattgtcttcaaattacttgtcactctttgttatcatcctcctcatttatttgtttgactttttcactagagtgaggacaatggccactatttagcacaacacttagcatataatagatactcagtattcgttgggtgcattaattatcacattggaaacacaatatgtattttctctattagtaaatgaaggaagttgttacagtgcattgggaactagactaattaggtatatttaaaattgagtgattgtggtgctctgtttctttcagttaacgtttgatgtttaattttctagtgtatttttgttgagggatatttatattgtttgttttaatttctataaggtcaaacagaatattatgcatctacatatttttggtagctgtcttgtaaatcgtactcttttcagagtaatagtactgattgaatgggtaggcgagtgaatgtgtttttggggtagggggaaccttctgtggctgacgattagatgatcagcccattcatatacaactgtgctggattgtgacatggccacatctcagctttacctttcgtggcctttattattgctttcttgcactaatggattctacttcacattatataggacatgggacttcggagcttaatgggatatcgatcttcatcatgcttaatacttacttttcaagagaaagcaattgtagaccagtgtggttaagtgacggttacaagccctcatatccagtaagcagaaggtatcaaatttcaatctggggcttttggttcattgtctagttttcttttgttcactaccatggagctatttttaaggcacatttattctattttttcaaaatatgtgtacattgcctaagcaacagaaagatcaatttcagtataatgataaaggtgcctcttttatttagttagcttttttacatttcctcagttgttactaccaatgatctaaaacctgggatattttacacatattgttgagatgctttgctatttaataaaagccccatatactctttaagtcaatgtagtatagaattagtgctagtttactgagagttgattggattcagtagcattgaatcattctaaccatctcatcaaaagttgatatacagatcaaaatgccagtttaaacacttaccaaaagtaatgttacttttgaaataattagaatattgacatctttgaattaacactccctaaggttgaaataaagttttaatttaggaatcaatcagaaagttgcttatttaatataaatctagtagagaataattagccctatggcaggcttacatattgtcactgaatatgagcctagtgaacttaccttctgcataaggattgacctactgagaacactagaataatcatgaaatgttattagttgatttggtgaccctctattttgaatagagggagaatatccaataatttatttacatttgcttgtctaggctacacaattttgtacatgaatctcagcaacagcttcctaattgtttctcctgctaatctaattaaagttccattgtaaatattaagttttttaaagtaaatcaaacgatgctacttctattcccaaagccctttatttccaatgcaacaaattgaattcatactcccttttataactcacgagactctgaatactatcccgttggtaatctcctgagcctcatttttttaaatgtgaaattgtatttattttttgtacattttgtagacagttttaacttttcagaatatttaaatgagtaatttattgtaaaatccacagaaaatttattttgcttatttatttaaaaaaatatttattaagagatgatcgatgttcaaaaagctgtagatatttaacgtatacatcttaatgtgttcggagataagaatacacctttgaaaccgtcaacacaatcaatgctataatcctatccatgacctcccaaagttttctcccactcttttgattgttttgttttttctttctgtggtaagagcatttaacgtaagatttatcttcttaacaaattttaaagtatacaatacagcattgttaatcataggccctttgctgtgcaggagatattcaaaaattttttgtcttgtataactgaaactttagaccttttgtccaatccttccccagtttactcctcccctatcctctgataaccaaccctttactctgtttctgtgagtttgactgttttagactccacatatacgtgagatcatatagtatttatccttctgttgactggcttatttctcttaacataatgtccttcaggtccattcatgatgtcacaaatgttcaggttttcttctttttttaaggctaaataactttcctgcgtgtatatatattaccatgagtcatggtgtcacaactgatttctttatccattcatccaccaatggacacagaggttgtttccatatcttgactactgtgaataatgttgcagtgaacatggaagtgcagatatctcttcaacaaactaatttcaattcctttagatatgcactcagaagtaggatttctggatcaaatggtaattttagttttaatgtttgagtaatcttcatcttgttttccatagtggctttaccaatttacattcccatcaacagtgtaaagtgttctcttttctctacatcctagccaacacatgccctttgttttttgataatagccaacttaacaaatatgagctgatatctcattgtggttttaatttgtattttcctgatgactggtaaaagccatttttcatatacttattggctgttttatgtcttcttttgagaaatgtctattcagttcccttgtccattttttgtttgggttgttttattgctattgagttgtttgagtttattatacattttagatattaaccacttttcagatacgtggtctgcaaatatttactctcattctataatttactttttcattttgctaactgcttcctttgctgtgcagaagctttttcattagatgtaatcccacttgtttatccctgctttttttttcctgtgctttagtgtcatatccaagaaatcattgcccagtctaatttgtagaagattttctccaatgttttcttccaggacttgtattgttttatgttttacagttaagcctttaatccatattgagttgatttttgcatatagcgggagatcaagtccaatttcatttttttgtgtgttgaattttgatttttccaaaaccattcattgaacagactatctttccctcattgtgtattcttggcacctttgtggaagatcagttgaccttatatgcatcggtttatttatgggctctctgttctactcaactggtctgtatgtgtgtttttatgccagtgccttgtttcaataactagttttgtaatacatgttcaaatcagggagtgtgataccgtcagctttgttcttcttgctcaaaattgcttagactttttttttctttactggtttcccttttccccactatgtatcagtcacatgagctgtttcttttctcagaatttgtctactttaaacacctgtcctcttgggctttctatctttggttacctttcagcctttaactcacagtacggctatcagtttctttcttgagcacaatatataacaaaatttcccctttacttttaattcatggtgtttttttcttcacagatgaaatataatttgatgtttgcccttgtttgaatactccatgaagatgaggaaaatacatgtttgtgtctaacagtgtctggcatgtggtaagtggtcggtaaatatactttaaatcaatgattgagtgcataaatattctttgttctttggttaacccttttttaaattccatgcttactaagctttttaacccattctctcttcataaaattatttaagatctctaggttgtagtgtgttttctttggcgatcgaaaagcaactttggagtttttatgtgtgccctcagttcactctaagagcactttatttatttatttatttttgatacagagtattactgtgttgcccaggctggagtgcagtggtgcgatctcagctcactgagacatgtgcctcccaggttcagatgattctcctgcctcaggagagtgccttgtttatgaaaaataagttaatattatccattatactagaatttttacaattgtaacatgttaaaaaatattcaagacactctttagagacaatatggaagagcttattcaagggagaatattgcaataggtatagggattgttgcaatgggtcttatagtgtggtagagacattggtcttgactctgattacaagaggaacaagtgcgaatctatggtcaaggagtaggggctggtgaatgaaaagttactaagagaaaacatcagggataaggggattcttcttacactgacttgacaggatttttattgaaggtaaaccagcatgacaagatattgagggtaaggaataaggaatttgatcagatatcaagggtgtttatgtaagggcaggggattttcactagactagcccagcaagattcttgctaaaagtgctctaaacaggcagagccactggaactaaggacaaagcccaaggtcagggcctagtcagaaagaagactcagaggagtctgactcaggcttgggcaatagcttagacttttttgaagtctaaatatggcaattccattacattggaagataacatgttaataatgcatctattgatgtccacagctttggtcagaaccacactaaaaagaaacgttaagaacttacctattatagcattttaactggataacaagtaggctgcatatggtatcatcacagtatctaatgatatgctacagaattaataatttacctctatagaaaaaaattataatcagttaatttgtacagttaatacattttctgagttttgactattaatttctaacataacaactatcacatatgtaagtgttttataagaccattatcacttccagcttcttccaaaatctcattttcttaactaatgtttatagtatttttgccagagtatatatcctaaaaaaggtgcccataatcaaaatgtctaaagtactggaaatatattatttaaaaaaaaaactaaatacctagctgagatttcacagataaataataaaaaatacccacaggaccaaactattgaaaaggaatgaagcaaaaaaagaagtgaggactgaagctgaagggtgcccaaggggaaacaactgatctctcttcgactagagcttccattttaactcgaggcccgcagaattggagcaatgactacagcccaaacaaagccctaaacactatgtcttttaaaaccagcaatccctggagtgaataaccacaggacacaatctagaaaaactatttatatcccaaaggaaagaaggaaacttgtctgtctcagctttagctctgaatgaggccagcaaaatctcgctaaaatgtcatttaccaaaaacatatacagtttttgagccagaattaacaccacctatggccacagaaacaccaggttacaaatatgtatttaactggtgctgtgattttaatgtcccagaaatctggtagaaacaaccataattctccctggaggactatatcttaagttcaagtctgaagggaagaattcccacagagaaagttccaaagaacatatgctcagtatcaaaaacagaacacatgaagaaacaagctatgaatttgagtcaacaaagcaggtaaaacagagtttgaagtataaagattgtagatgttggaataagtggctagagaatataaagtaagtgtgtttgttagaagaataaaaatatggctggcactataaaattggtcagttagattttttaaataaccaggaaactatgtagaaatgaaaattattgtagctagaatttaaaaattatggatatttttaacagcagattaagcatgctggaagataataagtgggttaaaagatacatctggggctgggtgcggtggctcaagcctgtaattccagcactttgggaggcgaaggtgggcggatcacaaggtcaggagttcaagaccagcctggccaatatggtgaaacctcatctctactaaaaatacaaaaaaaaaaattagccaggcttggtggcagacacctttagtcccagctactcaggaggctgaggcaggagaatcgcttgaaccagggaggcagaggttgcagtgagccgagatagtgccactgcactccagcttgggtgacagagcgagactccatctcaaaaaaaaaaaaaaaaaagaaagaaaaagaaaaaagaaaaagatacatctgaaaattatacaatattaaccatacagagtcaaagatatttacaaaaacaggcttaaagacatggagaagacgtttaaagacatggagaagagattcatgatttctagcaaaaattagatgcatattaagaaaaaatataaattaaatggtgatacgtaaaatatgaagagacaataactgaaagttttatcaaaacgattagatatgaattttcatattatggaagtgaaaattattccagcaggacaatggagaaaaactacagctagactgcgtaatactaaaccgcgtatgcagtctagcctagactgatagtatttcttgtaaaatacttatatatgtgatagtttttaatgttagaaattaacagtcaaagcttacagactgactaggctagactgcataatgctaatgacaaagacatctcaaaagctgctacagaggagagcagcttttattattttaaaagaataaaaataatgaataacagctatatacagtttataagagtcaagtataaaccaaaggatatttagaagcataaaagtaaaaagagaggaaaacacatcaggtaaatgctgaaccctgcaaaagtaaaataaaatattaagcaaagtaaagaaattaacgtatttacacacgaacccacaaaaagcatctttatataatgaataaagttttaccaaatggataggaaatttctaaatttgcatacatctaataatatagcctcgaaacatgtaaagccaaaaaatcaaaaggataaatctagcactatagcagggcattttcatatgctattccatagcttttatgatatgaattaggacattaattttgaaaaatatatatgattaacaaatttgattaatgagaatagttaaacaacaatacaaccacaattttgtaataagcattttttttttttgagacaagggtctctgtgtcacccaggcttgagtgcagtggcatgacaatagtttgcagcagccttgaacttctgggctcaagagatcctcccacctcagactcctgagtagctaggactacagacatgtgccaccatgccggattaatgttttttgttttattttttgtagagatgggtctcttgctatgttgcacaggctgatcttgaactcctggcctcaagctatccaccttggcctcccaaagtgttgggattacaggcctgggccaccggacccagcccataataagcattctttttaagcatacattaagcatatagatgctcaaattatagaatttgaacatatagacgataaacaaatttcagctaattttaaaatgtgctatcatctcagagaatgaatttaaaattgaaattgaataaagttaaaatgaataattatataatgcaaattaggaaatatttataacttaaggtaataagaatactacataccgaaggcctctaaaactgtgattaaaaacaaacgggtatccctaaattgtcttaaagtcggaaaattaatgatgcacacatagaaattaagatgcggtcatgaacagctcaataaatctcataaatatacaaggaagtaaatacacataagagaataagtaattaataaagtagaaaacaaagataaaatagatcattataaaagcgaaatgtttttcaacagggtttaaattagcaaaatttctcacaataataaaaaagcagaaaaaagagaagcagcaaataaatagtattgaatactcaagtttggaaaataatatgatagtcaaatattgatagccagggcatttcctaaaaaatgaaaaaagaagagtgacaatctaataaaagacaaatgtggaaatattgcattaacaggaatttaaaaatacaaaataggtgtttgtataattaaagatgttagactttggccgggcatggtggctcacgcctgtaatcccagtactttgggaggctgaggcaggcagatcacttgaggtcaggagtttgataccagcttggccaacatagtgaaaccctgtctctactaaaaatacaaaaataaaaattagctgggtgtggtagtgtgcacctgtaactccagctactccaaaggctgaggcacaagaattgcttgaacccaggaggtggaggttgaattgagctcagattgcaccactgaactccagcgtgggtgacagagtgagactttgtctcagaaaaataaaaaaataaagatgttaaactttatttgtaattaaggaatacaaattaaattatgggcacaattttagagccgacatattgacaagtgtgtaattgtaataccaattgttgcatgagtgtggatcaacaaaaacttatatagggctaatgaaaatgtacacccattttaaaaaacaagttttctctacattaactataatcaagaatgctaatcttaattatatatcctagaaaataatctggcattggtacaacaggaagaatgtacaagaatgttcatagtttttaatggaaagttggcttgaaataaatgaaatgtctaccaataaacaaagaaacaataagtaagtaaatgagtgaagtatgtcgatgtagaagaatattatacaaccattaaaatggatataattcagctacttatttcaacatgagtgaatcataactacacaatgaaatacactgtagaaaacagagaattccacataaagaaagtgtcattgtttgtgtcaattgattgataagtagctgtattgaatactttactgtataataacccctatattatctgttgactcgagattccaaactttaaaaatattgtttctagagtttaaaatattattggagaaatcatacttatatacccaaatagtaaagaccaaaacaaaacaaacaaaaacattcgaggcaatatctaaccaacagctaatatgcttggttcagatagtatggattttaggaatttagaaaaatgtgaagccagaataatagagtgcactctatgaggaggtaagtgataatacagtgtaaaatttaggtaagttgttggaaggcatatcaaagacaccagacccggtttatgtgccgtacaatttgagattctgccccagtacttcagctagtaaattgctcccctgttggagtgatgtaaacttttaatcctgaaggatgtgaaaccttggttactttgtctttgttcagtcatgtttggtgaatttgccaacttatctctaatctctaggcatgaaacaaccaagagacaatgcattggatctcctggattcccaaatagatactgtaaattgtattgtatagcagaaatcttagcttccgattttaatcaatgctgattaccatggctacatggctgctgaagtgaaatgactttttttttttgtctgcagatccactggcatgataaaggcatggtagttggccagatggtacatgtagtttctagttcaatggaactcttcctgtatctctaacagatgagttttcccttgacaccagaaactattgcctattagagacaaaggttatgaagtgaggaagcacaaactctctaaataagtggaggtcgaaatgagaaagtttgatcctacttgtactcctaggttcctgaactcatatgttcccagcattggtgtctgtattcatttgctaggactgccaaaacaaaataccacagactgggtggcttcaacaactgaaatttattttcctaagttctggaggttagaagtccaagatcaaggtgccagcaggtttgatttcttctgaggcctttctccttggcttgcagatggccaccttctcacctcgcctcactgtggtctttcctctgtgcatccacatctctgctttctccctgtgggtcctaatctcctcttcttataaggacgccaatcagattggataagggcccatcctaagggcttcattttaactttattacctctttaaaaaccctacctccaaatacagtagcattctgaggtcctgaaggttaaggcttcagcatatgaatgtttggggaaacacaattcagccccatacattggcagttgatttcgggaatgtactgcatcatggagaacactactgcacagccacaggctgttgtcctaaagccaggatatttgctgaaccttcaatggggtactcagccattctattaggccaaatatgtataatatgtatgatataagaccaattaatctaatagtggtgagaccattattctgtattttgctgacaatagaaaatgttgacaaaaagaatcaaattctgtgaaatattttaagaggtttattctgagccaaatatgagtgaccacagcctgtgacacagccctcgggaggtcctgagaacatgtgcgcaaggtggttggggaacagcttggttttataaattttaagaaggcatgagacatcaatcaaacacatttaagaaatacattggtttggttcagaaaggtgggacaaatcaaagcgggggcttccaggctataggtaaatttaaacattttctggttgacaattggttgagtttgtctaaagacctgggatcgatataaaggaatgttcaggttaaagataaaggattttggagaccaagttttattgtgcagaggaagctcccagatagcggacttcagagagagcaggttgtaaattgtttcttaatgggacttaaaagggtgcctggctcttagttgattatctcctggataggaggaaaggaaggaaaacgaaggggaaaggggattctctatagaatgtggattttcctgcaagagaccttgaaggacaatgaaggtagggtaaggaaatatattttggggttaaatattttttctttgtctcataatgttatgccagagtcagattgagaagtaagtcataatatatagggtcaaaaaaacccatctgatgaaaattgtttgtagggcatgactccttagaccccttagggaggaatttgtgtaaaataaaaaaatcagagcttagtcctcaaaaattatctattttcttttaaattgaaaacatttaaaaatctttttgaggggtatatttcagaatattcctttttaaaagtctgtttaactgtctcatacacacatattcacaaacactgagaaattatttttgttcatgaaatgaaaaatggcattgtttaaaatgatttactaaatcatataagtcttcaaactaaaacatattattattctctctgtagttccttttttctatggctaaatgtatttggaatgctatgtgttgttttcctggagagcgtcccacgtgattcttgagtgattagacaatgactagccattaagccactttttttgctttattattattttaaattttaaaatgggaatattatgtgattatttttcactgaagtgaaaatgcaaataaattacccaagaggtggtttatagaggagatacttttgttgtaggtataataccttttagtgttttatgaaaatcctcatttgtttctcagctggtaatgtgtcaatacgatgtatgtgtgaaattctagagttgcttgtgacaatgttctgtttgtttccatgaccccagcagttcctcctgcatagcccttcaggctagagtccctttattatttcatctacctccagaatgttgttctgcaatttacccacttttatagcatatacgaccatgaccaaacaatctagaacttatttaatacatacaatagagtattcagggtagacagtttacctaaatatggccattataggttgaattttgtcctcccaaaagagatgtgctggagccctaaccaggggtatgtcatgtgaccttatttggagataggttctctatagatgtaatcaagttaaaacgaggtcattatggtgcgccctaatccattatgactgatgtccttatataaagaggaaatttggacacagagatagacaagcataaagggaaggtgataaaaagagagtagacgatggccatctgcaagccaaggcaagaggactggaacagacactcccttcacagtcctcagaggtaaccaactctgccattgccttgactttggacttttaacctccggaaatgtgaggcagtaaatttctgttgtttaagccacccagtctgtcatactttgtcacagcagctctagaaaactaataaattcggctctctacaccttctattcaaattcctgacaatctgtctgtcttttctaaatcaaattgccactggaatcagtgagagaataggcttgaagatctttatggaaagaacagataaggactctttcctccttgggctgaaggagagtttccagattcttggaagaacctatcacacagagactcttagattcttagaaggaaatttgacattggtaaaaatttctccagtcagtatgaccttagggacctaattcagctcctaattaggtcctctgctcctgaggttgagtatatgcctggagacctgggaacaggaaggcttcatcctgctcctccgcagtgggtgctggcagcccttctgctcgtgcaccactggctcagtgttgtagagagtagtctgcctgcttgcagttgtttacccccaccaccagatctaagggctaataaagaaaataacaaacaggggttctaacagccagagagaggatcagtcagcacaaacagatctcatgacagcaaaatagagttgctgcaggagacagaacatacttgaacaaacaaataataagaactcttaggaaaattcaagtgcaccccaatcacacatactttctggaaaatcacatgattttccaattaaatgtttcagtaggtaaactgaaggatgctataacagaggtatagaagatcttatagaataaatgtgtcaaagcacagaagtgcaagttataataaacaaacaaacaactagccatttggagagtagatgaaataaaaataaccggcaaaagttggacttacgtaagaaaaaacatgacagaagcttaagtaaacaaatacaagaagagataccatgaattgagacaaaattatcagaagaatgagtcttactaagttttaggcaattttaaagtgaaataagcaaagctagccatccctgctataattaagctttttaaaaagaaaaaaaaggttataatatttcacacagagattctaacagaaaaatctaaacaaacaattagtaaaaaagaacctagccaatttatcaaagaaaaaatgtactctacagccaaggagggttgatagcaagaagacgagactctctcaatataaaaaaactgccaacataattaccaacaaatttaagaaataaagcatatgatcatttatgaattttgacaagcagtgggtaaaatgtttaaatttccaaataaaacaggtatgtttgtaagatacttgaatttagtaaatattgtcaaaaatgctgcataggctgggcatggtggctcatgcctataatcccagtgctttgagagtcccaggtgggaggatgactttaggtcaggagttggaggccagcctgggcaacagagtggagaccctgtctctacaaaaagaaaaaaaaaaaaaagaaaacaataaaacaaccaagcatggtggtgcatgcctttagttccagctatttgcaggctaaggggggctaattccttgtgcccaggactttgatgctgcagtgagcctacgctagcacaacctcaccccagtctgggtgacaaagtgagaccctatctttccccccacctcccaaaaaggtgtgtagactataatgttaaaagttaaggcactaaaccatttcaatcaaaccaattattattctatgacgccctggagattcagtgaatgtagtgaagtaatgacatataaaacaaaactcacatagccaatgaatataagataaaatttttaggtgtagatagatagagggaatggaaaaccgtgtacaaatggacaaaaatgcatagaatccctcaatatcatgtctaatatacttttgcatttttagaaaatgatatatggtgtgtatacatacaaagaaaagaaattggcaaatttttcaataactactaagattagcaaaccttattacccactcttcaggagctataactgaagaaacatttttagacaaatgttcttatttggtattaacagattgttttacttatattcttcaaattatgtaagaaatgtggaagccagccattcgaattcgatttgtcacatgcagttttgccagagctttttctctcatgattattggtgttcaaaagtttaacacttactgtattatttaccgtagataatattcatgataggaatcccatggctaataagcacaacttgactttgtatttattttatgcattactaaaaaaaattccattcacaaatactgactgagcctcattctatgtagtgttaaagaaaataaatgagagtttaatttttttacaaaacattatttcctggcttgtatcctttacattttttttttttttttttttttttttttgagacggagtctcgctctgtcgcccaggctggagtgcagtggcgggatctcagctcactgcgagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcctttacatttttgaagttaaaaaatatgttacacagctcattcctttttttcaaaacatttgaattgtactcagaatattatgctttttgcctttataacatgaatttaaaacatacagataattttatttgaataggttacaaaatgcttaccttaaaaatatatatatatagtatttctttttttaattgattttttctgtgatgatgttatttatgccttattttgacactgtattttttaaaattaaattagattttttttaaacttccaggttacatgtgcaggatgtgcaggtttgttgcacaggtaaacatgtgccatggtggtatgctgcacctgtcaaccatcacctagatattaagcccagtatgcattagctcttttacctaatgctctcccctattgcccttccctgacaggccccagtgtgttttgttcccctccctgtgtccatgtattctcattgttcagtgcccacttataaatgagaacatgtggtgtttggtgttctgttcctgcatcagtttgctggggataatgacttccagctaatccatgtctctgcaaaggacatgattccttttcatggctgcatagtattccatggtgtatatataccactttttctttatccagtctatcattgatgggcatttgggttgattccatgtctttgctattgtgaataatgctgcagtcattgcatatttttaatgtttttccttttaggtaaacatttgatacattttcattgcaaaaattttctcccctcagattattacaatgattttcctgctaattatttatcctttctttctttattataacgtaattttcctatatactactttaagaacatttacaagtgtattagttgaaaagtactgtaatatcagaagaattgtgataatttatattacagatcttcaaatgatacccaaactcttaagtgtttcgttttatagatgatacattatctgttggggggataatgtttcattaaacttatgcctaattttgtgtttatacttgtctgaaactatacactgaattcttttttgtaagtacaatagtttggttgtagctgggagctgcttgctacttgaagtctggaattgttatactctcaataactgtcacaaattttttactttgtaaaagaaagttttaacttctcaattgagaaactttattttaacacctccatttattaacacccttaacaaatttaggcagcccttttctatactgtgtgattatttcaactacagagtttgtctaagtattgaaatttttatttacattcttgtttcttcattagactgagaacacatttttttaagggcaatgtcttgttttagtttacatcacaaccttaaaacttactgaagtgcctgacacagatataggataaaattaatatttagagtcaatgaataaataaaatgtatgtttccattaacaatcggtggggtgtcttttttggtaagttggaatttctctccagtgtgatcgatttgccttcatgtaatagttaacagaactgataaatggccaacataacaattcagccttttttcatattaaacagataccattgaaacagatgttcctgcattaggttctcaaaacaaatgaagcatggctttgattccacacatacaaaaacaagtgattcacaatggcagtttcaaatttgtggtcacaatgattagtgttctacttgttacaaaggatttgattagtcattttctagacattttgaaattttaattatctggaatatttaatatgcattttctttttttaatgccctgtaaatgttttaagaggatgaatttttaaaaccttgtagaacttttgtgttctagaaatatggttgagtgtgagaaagatctctatttgctgagatagcaaaatgtttaaggaaacctcaagaccaataaaaatatttttaacattggcttaactggcctgaattcaactcccagcattggcacctactctctcattaccttgcacaaagtcattctaactaagctttagtttgttatctataaaataaaagttgcaatctgtttcatattcatatttcatttcatacgtttttctttgctctcaattccttccaaaacgtttgatttttttagaattccttttgaaagttccaatgttatttatgggaacatttcttaactgtaataccattttattttttccacagaaaatcccaacaatttaaaggttaaaggtaatatttttattttattattaatataactttgaaataacagctttattgagatataatttacattcataccataaaattcactctttgaaagtatgcaattcagtagtttttaagtatattcatataattatgcaaccattaccactctctgattttagaacatataaccactccaaaaatagaccccacaccattaacagtcactactcatttccctctgcctctagttcttggcaaccacactaatctactttctctccatggactgacctattctgaacatttcatgtaagtcaaatcacatatatgtgggcttttgtgacaagtttctttcacatagcttaatgtttctcagatttgtggtaatacccttatgtttagaattagttttacgtctagcaaatatatgcgtttatggttctatttttaattcagtggactttatttttctagagcagttttaagttcacagcaaaattgggtggaatgtatagaggttttccaactgtatgaaattatagacccctacttccacaaaagtatagcctgtgtcataatcaacatcccctaccacataaataccccaactcccacaaatctatagcctatgtcataatcagcatcccttatcacagtggtactttttaaatttttacaaatgatgaacctacattgatagatcactgtcacccaaagtccgtagcttacattaaggttcattcttagtgttgtacattctataggtttagacaaatatacagtgggatttatcaaccattgtagtaccatacagagtagtttcactgccctaaaaattccttgtgttctgcctattcagccttccctccctccacccctgttatccactgatcttgttatattctccacaggtttgccttttccagatgtcatacagttggaaccataaagcatgtagccttttcagataggtttcttttacttagtaataagcatttaagtttcctccattctttttatgacttcatagttcatttcttattagtgctgaacaatgttctactattctgtgtagagcacactctatccatttgcctacttctgcaaatcttgattatttccaaatattggaaattatgaataatgcttccataaacatatttgtgtaggtcattttgtggacataaattttcctttaagtaaatatgaatgagcatggttgctaaatcatatggtaagaatatatttagtttttaaagaaactgccttctaaagtgtctgtcccatttcacattcccaccagcaatgaatgagagtttctgttgctctacatcctcccaactttggtgttgtcagtattctggattttggcttttctcatgggtgtgtagtgttaccctattgtcattttaattcccatttccctgatgacatgtgatgtgcagcatcttttcatatgttcactttttatctgtatatctttggtgaggtgtccatgaagacctttggctcattttaaaattaggttgttttcttactgttgagttttaagagttctttgtatattttggataccggtactttatcagataggtgttttgcaaataatttctcccagcctctggcttgtctttttattccctttagaatgtcttttgcatagcaggcttttaaaagttttaataaagtccagcttattaattctttctttcatatattgttcctttggtgttgtaactaaaaagttaccaccaaacctgaaatcatttatattttcttctaggctatcctctaggagttttatagatttatattttacatttaggtctgtgatttattttgagtcaacttttgtgaaggatgtaaggtctgtgtctagtttcaacatttttttttgtatatggatatccagttgttccagcaacatttgttgataggactgtattttctacattttttattgcttttgctccattgtcaaagataattttaccatatttgtgggttgtgggctctgaatactgttccattaatctatttatctatttttttaatacctctctcttgattactgtagttttacagtagttttgaatttgggtagtattagacatttgacttttatttcttcagtattgtattggctactctgggtcttttgatactacatataaactttagaatcattttatcaatatacacaaaataacttactgggattttcattgagattatgttgaatctatacagctgacatcttgacaatattgaatcttcctattcatgaacatggaatatctctccatttatttagttctttaatttctttcatcagcattttgtgatttccttcatataaatcttatataagtattattagatttctaccttttaagtatttcacttttgggtgatgctaatgtaaatgatactgtgtttttaatttcaaactccacttgttcattattggtatataggaaagtgatgaatttttatatatcaactttgcatactacaatcttgctataatcttactagctccaggacctttttcattgattattttggattttctacatggacaatcatgtcatcgacaaacaaagatagttttttttatttttatcttcctaatctataaacctattatttcctttttctgtcttattcaattagctgtgacatccagtatgatgttgaaaaacagtggttaagagaacatctttgacttgtgttttaatgggaaagcttgaagtttcctactgttgagtatcatgttagctgtaggctatttgtagataatctttattaagttgaggaagttttcctctagttctagtttactgacagtttgtataataagtggggcttagattttgtcaaatgctaattgatttttaaatgttgaaccagccttacataactgggatgaatccatttgggtcatggcgtataattcttttatacattgtttgatttgatttgctaatgtttttaaagattttataatctatgttcatgagtgatattggtcagtagttttcttttcttgtaatgcctgtggtttgatatcagtataatgctggcctcttatgagtgaggaagtattctatttgattttatcttctgaaagagtttctagatcattgatattatttcttccttaaatgtttggtagaatacaccagtgaacccatctgggcctgacactttcagttatccagttatcaatattgattaagtttttaatagttatgggcctattcagattttctatttcttcttgtatgagttttggaagatgtacctttaaagaattggtgtatctcatctaggtcatcaaatttgtgtgcatagagttgtttataatattttattttattcttttagtgactatggatctgtagtaatatctcttctttcatttgtgatattaatattttgtattatctctctttttttcttagctgatctagaaaattatagattttattcatctttttaaagaaccaggctttggtttcattgattttctttagtgaatttctattttcagtttcattgatttctgctctgatttttatttcttttctcctgtttactttggatttatttgctcttcttttcctagtttcggaaggtaaaattttagattgttgattttagatattccttctgttctaataaaagcattcaatgccataaatttccctttgagaactgctttttctgcatccacaaattttgataagttgtttttttcatttttatttactttgaaatacttttaaatttctcctaagatttctttttttggcccatgtgttatttacaagtatgttttttaatctccaagtaatttgggattttaaaactacctttttaaaattgatttctagttaaactccattctggtctaatagcagccactgtataatttctattcttttaaatttggtaactgtgttttatggctcagaatgtggtctctctttgtgaagcttccatacaatcttgagaagaatgttattgttgaaagaattagtctacagatgttcattatatccagttgatgatgtcactggtgtgttcagttatgccttaatgaattctagctgctggaattttccatttgtgagagaggggagctgaagtctttaattgtaatagtggattcatctactttttcttgcagttctatcagttttagcctcatatattttgatgccctattgttaggctcttatatattaataattattatgtcttcttggagaattgacctcattatcattgcgcagtgccccttgttatccctgataatttccttgctctgaaatctgctctgtctgcaattaatctcgctactcccactttctttcgattagtgttagcatggtacagtaatcccccttatccacaaggaatatgttccaagactcccagtggacacctgaaacagtggatagcatcaaaccttatatatgctgtgtttcttcctatgtatacatatctacgataaagtttaatttatacattggacacagtaagagattaccaacaataactaataataaaatataacaatcatgacaatatactgtaataaaagttatatgaatgtgatttctctgcctctctaaaaatattttattgtacagtattcacccttcttgtgatgttgtgaaatgatacaatgcctacgtgataagacaaagtgacatgaatcacataagccttgtgatgtagcagtaggctaatgatgaccttttgtattcttaaatctgtgtaaccatcttttaactttccattaatgacttggtgtcattcatatcaggagatttcttgatagagtctttgcataggttcaacactttttggcacaacacgttgctataattgaacatgttttcagttcatgtcttccatccatgaattatgtgctttttctacttaactaagtacttatcatacaatgtggctagagcttttgcagtttaaggtgtgacagaaaactaccataaatttcttttgcttcttcataagtttatggatagaatattcattcttactgtagatcttaacaacatcaatatatgctttttttccctttattaagttgaggatttttacctcttcacctaaaagaatcactttatgtcctttctttggcatgtttgaattttcagcatgactattattgcattttggaaccattattatgtaaaatacgaattaacctgaacacaagcactgagatatcatgatagtcaatctgataactgagacggttactaagcaactaatgggcaagtagcatatacagtgtgggtatgctggacaaaaggtttattcacatcccacacaagataatgcaggattgatggtgtgagagtttatcatgctaccaagaatgatgcacaatttaaaatttatgaattgtttacttctggaactttccatttaatattttcggactgtttgtggctgctgttaatgaaaactacaggaactaaaaacaaaaacaaaagcaaaaacaaaggtaaggggggcctactgtatatctttcctcatccatttacctgtaatctatatgtgtccttatatttaaagtgggatttttttagacaacatataatggggtattttttaaaatctgttgcttaattggtgcatttaaatcactgattcaaagtgattagtgatatagttgggttaatacctaacatatttgttagtttctgtttgttcaccttgttctttattcctatttttgtcttacactatttttctgtcgtttgtggttttaattgagcattttatatgatttcatttgctctccattcttagagactttttaatgtttgcacagagtttacaatataaatttacagtgaatccaagtcccctttcaaataacactatgccacttcatgtgtatcttataataacaaaataattcatatttttctctctcacccttattgtcattcatttcattcatgcataagcatagaaaagtctatgtatgtacgtaagcatacataattgaatatattattgctattgttaacaaacatctatcagatcaattaagaataaggaaaatacaagtttttattttactttcacttatttcttaagtaatgctttcctttctttatgtagatgtgtgtttctgaactatatcattttgtttttctttaaagaacttcttttaaaatttcttgcaagtcaggtctactggtaacaaatttattaaatttttatttacctaaaaaaaaaattcctttacatttgaagagtaatttctcagggtacagaactctaggtgttgtttttttttttttcctctctcaacactttaaatatttcactccactctcttcttggcttgcatggtttctgaagggaagtcagatgtaactattatctctgttcctctacaagtgtggtaggagttattaagaaattattttaggcagatagagaggaaaagaggtccttggaaggtttttcgcagctccaaaaaaacgtttcttgtatagcatgaaagccctggctcttaaacctgggacggcaacctttaatatgcaaatgccagcctttagaaactggttccacccaacatggcaattcccactgttgtcctcttgcccttgccccaacaggtgcctgacaacatggccacccccatatatccccatgtgtgtagaacatcatggtgccctgcatttgcatattaaagggctggggtggaaaggccagttttcttgctggctaagtgaataacatacctggtcaaaccaattccctgagccctgtgcaaatcaaacaccgcctcctccagccatggcataaaactggctggtatcctccaaatgtggggtctcctctttcagctttggagcccccctccctctgtctttgtacgtgtaaggactaaactctgtgtaaggactgtgtaagaactaaactctgacctttttcccccttcctgcccacattcttatctaagagccctggcaagtcatgccttatacaccatgaaatatctttagatgggtttttattaaccctatataagttgcttactttccaacctgactatagtatagcaccacatgacatatagcagactgaaggaaataaaaatattttacccctaaatgtacttctttgatatattttgaaatggctgtcacaagccagcagactgaagtaggagaaatttgtatctgtagagaatggagattaatgcagccacatttcccctttctatccctgtcctggatctaggagaaattgagagtctgacacctttgaaagtgagaagacacacatttaccatctattccctctgacagtttccacctttgagggtctatttacacaataagaagcctggtctccacaatcccattaatcttaactcagtcattcttttgtactggctttaagtctttagatagtttcttaattctctcaaccaattgtgaactaaagaatccctaaaactcacctatgacttgtaagccctcattttgggatgtcccacattttcaggacaaacccatgtataccttctgcatattgatttatgattttacctgcaatgtctgtctccctgaaatgtataaaaccaatgtgtaacccaatcaccttgggtacactttctctcaggacttgttgagattgtgtaacctgggctgcggttactcatattagctcagattaacatctattcgtatattttggcagatgttttttctccatcatcatgtggtttggtgtctgacttgatttggggaaaatcttggttattattatttcaaatgttcttctgttcctttatctcttctccttctgatagtgcccttacacatacattacagcttttgtggtttctcacagttcttaaatattgtgttctgactttttagttttcattctcttttctctttgcttttaaatttcagtgatttctattgagatggactcaatctcagagattctattctcagctgtgtccagtctactgagaggcccatcaaaggtactcttcacttttgttatagttttttgatctctagcatttggagggaagtctttcttataatttccacctctttgttcacattgaccacctgttcttacatgttgtctactttatccactagagcccttagcatattaatcatagttattttaaattccccgtctgttacttccaacaccctgccatcgctgagtctgattttaatgcattttctgtctcttcacactgtgttttacctatttgtatgtcttgtcatttttttcctgccaggtggacattatgtactggataaaatgaactgatgtaaacaggcttttagtaatgagctggtacagtgttgggggaggggaaatgttctatagtcctatgattaggtctcagtcttttagtgagcttgtgttctggactgtgaacttctcaagtgcttctcagttttctccacttagatgtgacaggatgactagagggatctgaaattgggtatttcctttcctccacaggggatgctagagccagctgtggttggatatttcacttcccccaggtctgtgaggctctgataaaaccaagaagttaggctttgattaaataatctcctctgagggcagaccttgttaagaataaatgaactctcaggcacattcaaatgggttattttcctctgacctggccaaaacatgatgggattttttatctattacttattgtgagggcctggagagctccaggaggtaacatgcatgcaagtgtgttgggggtggggggggggttgcaccgtaactgggttcccgtttttaactctcaagaattgtcctcactgagcctccactgactcacagttacacttttggttttcctatcctcgcactggttccaatggtggtttaaactcacaactctctgttccaatatgccctaactgcctgtattcacctgtttgtctctccaatttggggggcattggtttgtctgttaaggtactaagaagaattttcaatttgacttcctcttttcctaattgaataccctttatttccttctcctgcctgattgccctggccagaacttccaacactgtgttgaatagtagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttactgaggatttttgcatcaatgtgaacaatgagaacacatggacacagaaaggggaacatcacactctggggactgttgtggggtggggggaggggggagggatagcattaggagataaacctaatgctaaatgacgagttaatgggtgcagcacaccaacatggcacatgtatacatatgtaacaaacctgcacattgtgcacatgtagcctaaaacttaaagtataataataataaaattaaacaaaaaaaaagaagaattttcagtttgttcaggatttttcttattgttagactgaagtggtgatttataagcttcttacatggtaggccagaaactggaagtttcttatggttctcttttaaactattttaaaaactttaactgatattagatttggggggttttttgtcattgtttgtttgtttgtagctttggtgaatatttggcctttttttattttttatttattttttattatactttaagttttagggtacatgtgcacattgtgcaggttagttacatatgtatacatgtgccatgctggtgcgctgcacccactaactcgtcatctagcattaggtatatctcccaatgctatccctcccccactccccccaccccacaacagtccccagagtgtgattttccccttcctgtgtccatgtgatctcattgttcaattcccacctatgagtgagaatatgcggtgtttggttttttgttgttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggtttcaagtctttgctattgtgaataatgccacaataaacatacgtgtgcatgtgtctttatagcagcatgatttatggtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtccttcgcccactttttgatagggttgtttgttttttccttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttaattagatcccatttgtcaattttgtcttttgttgccattgcttttggtgttttggacatgaagtccttgcccatgcctatgtcctgaatggtaatgcctaggttttcttctagggtttttatggttttaggtctaaggtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgtttaaacttctgcatattttgtcttgtaaagggaactttgctagagcgtgaaacacattcattttaaaaattaggcatgtttaaagcattcctagaagacaatgtggtagatgtagatgatgtacaaatgaatactagggaaaaaatcttattctaaaatagagtcaagtcacacaggttaaatgataaataagctttatttcagttcctcaaaatacttccctctctcttctctaaagcgtttatatttactcttgcctctaactgggatgttcaactctctgcatggttaacttctctagtcctccatgtctcagcttgaatacttcccagagaaagcttcttccatcttgtgtaaagcagcaccatacctgttactctatcacatcatctactttgtttaattaccaggtcatgataatctattttatggatttacttatttattttgactcttgtcttgtaaggtatgcttcatgaggtaagtacccccttagacttttttctttatattttcattacttagaatgatcactggcacaggatagatccttaaataatatttgaattcaaataatgaaaggactacaaatgagcttcagagaggagaagtttcaggatgtaaaatggcatttataattgagatcagtcttctcttccccttacccacttgcattcttttatcttaggataaaagaaaaaatgtgagagtgaaaaacacaaggtggtgggagagagagaaaaatagatgttttttatacaatgtgcaatattgaaaatttgagaacacagaccaggaagaacatttgcactgattgatggagtcaggctggaaaatttggcaccattcctggcttagtctgtggggtccttaacattgatagtcaacaataattggtgtagacttagcaccaaggtcagcctcagggtcagacatttgaatctgcggcagctgcagatgcagttgtgtctctagtgagtgtcaatagcatggttgacatttggaggaaggatatttactaagaaaaagaagaaagagaaagtgataaaacataatgcagtagccatggagaccagcagcttcatggagcattgggcatgacacttgtaggaacctctcaagattatctaggaagagattaagggaggttggctttgttgaaaaattaataggaacatgcagtaccagacaagttttacattgtgaacttgtttttaatcttttcttattgccagattgctgaggcctaagaaacaaaggtttgcttctaaaaataattatcttctttcttcgcccctttgatagagaaatcacaagacaaaacaaacaaacaaacaacaacaaaaaaaacaagccaaaaatccctcaagtacctccaaacattttctgtacccaaaatgttacaaatgtctaaaacaagtaaatgtttctttcttctagccatataaattaagaagaagaatatagacatttaggataattaaattcttttcccatgttccttgtgttcaaagcaaagttctctgggttttaaggtagcaaaaaatcgtgaaaattattattcccacacacttccatatattctcatatcttaattatgatatatgagttttttaccaatataggccacacttgacttgagtgttttaattattttttgctgaatgaagggaaatttatgacaattcagactcactcttggctgaatgaatgttggtagtgtccttgcagtctcttcttttagacaaaggactggtggtggtcacttatgttctctacaccactttcccatacttgtgagagaaaggtcccagcctggtcaaagtcttacaaaaataaatgctgagaatgtccgtcttggccattgatctgttttctgttccatgcttttgtaaacccctgtggtgatgtattagtccattttcacatcactataaagaactgcccaagactgggtaatttataaaggaaagaggtttaattgactcacagttcagcatggctggggaggcctcaggaaacttacgataatggcagaaggcaaaggggaagcaaggaccttcttcacagggtggcagaagagaatggagccggcagacgaaatgccaggcacttataaaaacatcaaatcttgtgagaactcacgatcacaagaatagcacggcggaaaccatccccatgattcaattatctccacctggtgtgtcgtttgaaaggtggggattaagggaattatggggattacaattcaagatgagattttgagtggggatacagccaaacaatatcaggtgactaataatatgaggaattttcctatgtctttctctaacttgtagcatatagaagacattccacctcacaatgacttcaatggtagtatgctctactacttttttctacagataattacttcaacagtactagaaatttatgtactacctttaacgcttagggtcccatgacacagagtgtaaatttttcatccaagtcttatacctgtacctaagttgtattaaaatggaatctttccttagagcattcagagactgacaaaaccttgaaataatttcaagtaaaattatatttatgtttatagatgtacattaaaaatcagattcattgttgaatcttgacatttattcaagaggacattcactttagaaatagctcaagggcatttctgaaattagatatcaaatttgaaggtcaataaaaagatgatgctttactttttagccattttctttgcctcggtgttgctctaggcatgtgtgtgtgtgtgtgtgtgtgtgtgtgtatgtgtgtgagcatatttgagttgttattagattctctccaatttatggtatattttatattcttgtaaaactgcctacaggaataggttctactatatctaagaaataagaatgacttttttaaacttagaaagaatgatacataaactgatatttcttattcaaaaatatctaataaattatataaatagcagatatttaagcacttattatctttcctttcagctatactcatattatggaatctttaagctgctttaactttttctcatactatttggtataaaattttcctatataaatgttttcagcttttaggtcaaatatagtagcataatattacaatatgaggacatcacataaaagtcacagaaataagtgaattaatatttatatgcatagcaatattttttagtataatacacatagtcacaattgaagtataaataaatgatcatatgctgtttaaatcgtaggttgttttagcttgaggactgccatatattgccatctacagtaacagctacttctttaacaaactgaaagactgctatatgtttccccctcaattaactgagtgatgagtctgaacagataaaggaaacaaattggcaaacgtgatctgtattgcctgccctggcattagaagtttggacagattatatttccataataagagtactgtctgcttgagagtacctagatgaagtggagtttttaacataccaaaccctcaaaccaattagaacactgcatggtggcaacaagagtctccttccctttaatgagcccttggtaataaaagtctaccactgctgctacaatctgtattggagataaatttagcaccaaaatattttcatataagcaatgggctttagtcgttgtacctaaactatataataggtgcccttcctacttaatagacttccttcctgaacctcttgatcttgactcccattgctgtctctgaagcagaaggcatggatgattattgccttataccaaagactcttgttctgtaagctcaaagatcctctaatgtaatgcaattcactgtgtgttcaggtatcatctggcctccttcacattgcactgtaggaaatgtgacttggaaaactggtacaaacaaaaaagctgatactccagctactcgaattgctgtagtaattcattatttttttgtctctgacctgggagtctggtgccttctgcaagcactcatgaggttctggtatgttagttggtaagtggcatgaatctttaatccttcagaattcttgttggtttgggctatgaaattgggacgctgaaagagatacaaaattttggagagaaagacaaaggcctagtgttcttggatcagtgatatgagaagacttcctggaatttgatggtgaattcctgcctgtaaatgaaagtctggagggtgagtggtgtcttggtcattctcactcttcttagggcaagcaaaggaagcagcagtatcagaaagagggggcagcaaacctcaagtcccaatctgaaaggccgtgtagttgtggctactgagtcagagttctgaagatgaagcagtgttggcaatgaataccttgctatcagtataaagcttggtgatgctgaaagcattagaagttcatttggttgtgccatgagtgactgacaattgaaactgaatgtgccttgcttacgaacatggaaccactctcttcctcttcacctacagttccttatttatcctctattctaatttaatatgctttaaggataaacaagattaatggtaaagccaagatttctttagttccaaggaggaccaaaggtcatatacatactgaactttggaataaagtggtattctaactttttgactgatggatcaggcacacaagtcaccaatgtacccactcccatgaggggagcagatgcttataaacagtcaatgtaatttggctagggtttataaggttcacagtaggagaacaaggctaatgtgaccttgtgtgtgagcctgttagaccaactcaatatacttttttggttgcttttacaactaaatatagcgtaaaaattaatgtgttaatacttgcaactcccatcccaataatatcagagcgcatgctttcaggagctggtgtagagaagtccttctgccgttgggggtacggaaaccctaatgacattgttaaatctcagtgactgataattttgctgattggagccctgtcatgagttgaaatgtttcccccccaaaaaatgtacgttgaagcctgaccgccaccccacttttaaatgtgacattatttggaaataggatctttgcaggtgtattcaagttaagatgaaatcatagaattagagtggaccttaatccaatatctggtgtccttataggaagaaagaaatttggacacacatagggagatccccatgtgaagacatggagaacacaaggagaaaggacttgtgatgactgaggctgagatttgagtaatatagttgcaagcaaaggaaagccaagtattttttggcaattactagaaagtaggaagaggcaaggaaggatcctttcctaagtcttcagagggaacatggccctgccaccactttgacttcagactttgaccatccggagctgtgaggacacaacttgctgttgttgcaagcctctcagtttctggtactttgttatggaaatcctagagaactaatacagaattcttggtcgttttggctatgaaattgggacagagcctctgatttccacatacaattgccacttggagttttatattcatgacttctctgacatgactctcaggaaaagcagctattagcttgcaactgggctcttgtggaaactagacacctcatttatggagtcattgtgactacaacctgatacttccattttagggtagttcaactcggactcaatgactaacaatgtgagaatgacctaacaagtctcacttgttaaatataaatggtatattcaagaatgcagccagccttgtcccattggaatctttgtttagatgaaaaaatggcagctgttcttttgggggaagcattccactgcttaaagcaaaactgctagctcaatggggcctacaatgcacagagagtttcttcaatgcctggtcctggatcactaagggtattcattgggattctgtggctgttcaagctctgcactgactatacagaaccaaaagcacaggtggtcatgccacccagtaggcagaactaaagcctcttctcatctctctttctggtcaatactcccacttagtaaaacattttattttatggattcatgaacagttgcaaataacatagctatttggaatgccattttaaacattacagactatcagattaaagacatccttgtttggaactgtggcctatggaaacaaattgcagctactgttcaaactgcctggttcgtttatgtagatattcatggtaagggcctgttttctgatgataccaactggaatcaacacttcaatcatagacaaaggtatttgatagacttttcacactccctactattcataaccatctaacattgctggacattggaatgacctcttcaaaaattgacttaaaaatatttctaaccctacatcctttgtgtcaccctgatcaacgtaccttagaaagaagggcattctagtaaattaatgtggctatctccagaaagggatttgctttcacgtgcttcctgggtagtgattgggagaaaagcaatgggagctatgtagacagattttgaaaatttgggatactgttgtaatcattcccaagtatgatgtttctttctttcctctagcaacaactccagtctgttcttgatgttataccctattagtggcagtccactgaaagcaggacctagctgattcaaaattaattctgatttagacacttgaattctcttattagatatgcatggtcatatattgaaatgaccacttggttgagtttactgcttgttaagtcccacagtagtggcccatgtgagccaaattgggtcccgtagaaggtttttgtaagttttataaaaattcctttgtctctcttagacttgagctttccagatcaaagatctgaatgtgagtagggaatgatttgaaaaaaacaaatgcagtgatagctactggaagagactttaaggttgtagcagacagaccatagagtggtccctggggaccctcacttgtttattatatagtgctagaaagcctggaaaaattgtctcctaatgtttatgggaagcagaacttctaatgatagacttatttatttagctaaagagatttccaaacaaagtgttgaaggtaccatctggtttcttcctcctgcttatagtaaaatgtgtgtgtgtgtgtgtgtgtgtgagagagagagagagagagaaagagagagagacacttgaggagaaaactgtgaagcaaaaaggaacgaggaaccaggacttgatgaatttgaaaattctcatcatattaaaatggcaaaagatgctaaaattcagacatcacttctgaaatcttgatatagagaaaaagccaaagatgtggctgtgttaattcttgctaaaacttaagaaaaaaacaaaaagttaaagttttcagttccacaaagaccctttgaagagtttaaaggtgtgtattgtagctcctcttaatcaaaccataaggcctacaggaggcttaagggcactgacccttacccatctcagcaggaggttaaaagagagaatggattaacttgaaaagatctgtggaggtagattttgtcaaatcgagtaaagtctacttaaaatccatgggagacctacaaagtttttgcaaaatttatttcattaaaaacactgctccatagactgaaaaggacagagagagtgtaaaatgaaagaaagttgttagatctctaaaattgtacttacaggaagcaggctgataaaaccacttagcagcaaaaattctaccttccatgaaaaaggaagaatccatagggtagatcttaataccatggagggcaattccaggtcttaaaaagcaattaagaaatgacaaacatttacctatttgtatttaagttctactgaaccactgtttctgccctccattttaccttctttttgactgggactgtcttctgctgttattctattttagtcttaccactttatattagtgttctaggggttgacaacttgtctttagtttttcagatccacagttagagaggaattgtcccctgggaactgtacttaaaagatttcagccagaagcctcatctgcgcctggacctggtttagatgatgaaattttgaactttgagcttgatgctataatgaatgacactcttgagaactttggaaggtagtgaatgtgtgttgcaggtagaagggacatgagtcattgggggccagagggcagactacggactatggtaggtagatcatgggatggttctccctgattcctctctcctggtgtatactccctcatataatctctttccattgatcacgggctggacattggacttataaccaatataattcagtgaaggtgatgggatgtgactcctgagattacattatgatgtgtaacattccagcaaacttagtttagagaacttctctgtgttggtggccttaaagcaagatgctatgtggtgagatacagtagttgcaataactgtggatggagcgtctagttcctgacatagtctctcataagaaactgaagcctcagtctttcagccataaagaaataaattctgccaacaacccgagggacccttgggagcatattttccccctgtcaaacctctgatgagaccacaaccctggtaacacctggattgtagcctggtgaaacccttagcagaggacccagttaagccatgcacagattcctgacctatagtaacaacaaaataataaatgatagttcttttaggatgctaagtttttaataatttgttacacaacatggaaacctaatgcaggaatgatgaagggagaacagcctcatcacctgagaaaggaatacctcaaaacccaggatgtaggaagaaggaaggatagtgatttttttttttgtctttcagattactcaaggagccgtctcatgtagaaagatgccctcataggctctcacaaactgttgcaagcatctcaaattttattgactgctgggtcttacaattcctcaccagatggctttgaacacagttcgatcatcaatctcattgatgctactgataattctgttggaacagcaggagatggctctagctcctaaacctgccactcgaaacacctgtcatcacctccaaagatctttccaatacccactggtacagttgtaactcaatcacttcgcaagacagataattgcatgtggccaaagatgtacctggtcaacaggacaggttagactatctgctctcaggtagtccctccaaatcaatggctggactcggttgttcaaaatgaataggaaatcctaaggcttatcagcaaattggaaagtcatgttcgaggtcctatcaagctaggctcctaaaagatatagtccccacctggaggaggggatcaaagaattttaaacagctctttcattttagggccactatttgtgccctaagactatgcttcttgtacagaagctagctattaatttgcctcccactcaaacatgtttgcttaaaaactttaattgtggttattagggaagttcagagtgatttgggtcacattaccagagatcatgtatccaaaacacaactgtagagatctctcccaaatgtatctacccttgtttactcatgggaacttcctgggaatgtaactgactcattacattgtcacaactgtgggcagtttccctaaaatgggaatcatccagttagaaagggtagtaaaaaatatgtgtccaactttatctaaagtcatcagtgatgccatctgacccttgaaaggtattcaggtcggccgggtgtggtggctcacacccgtaatcccagcagtttgggaggctgaggtgggcagaccacctgaggtcaggagtttgagaccagcctgaccgatatgatgaatttttagtctctactaaaaatacaaaagttagccaggcatggtggcatgcgcctgtaatcccagctactcaggagctgagacaggagaatcacttgaacacaggaggcggaggttgcagtgagccgagattgtaccattgtactccagcctgggcaacaagagcaaaactctgtctaaaaaaaaaaaaagaaaagaaagaaagaaaaaaggaaggtattcagatcagcctcaactcactggtaaggattgccttagatttttatccttgagggccaaggattagtctgtgtaattgaaaatatatcctgctggattaatgctatggaccatttcaatgcagaaacttgtgaaagacacttcttggttttctaaagtagaccttattgatgtataggaattattctataaataccttgaaggacatggatgagcataatattgcagattgaccagatctacttgtttagagtactagagatagtagccttatggtcagattattcagggtagctgttgagattattcagggcagctgttgacatggcataatctaatgggaaaatttgccagaaaccaagatgatattgattagagggagtgctgttttggggaaacaattctctatggatctctgatgtctccatgtcttacaagcagaagcactgactgctgtttgtcctggactatcttttaaggcatatttacatagagatagtgtcttcacgggagcaaagagcacacatgcttactgcccagataatgtttctctgagagcaaaaagcagaaatgcatcctgctcattactaaagattcgtgtttcttaagctcagtgtctctttcctgtggactacaacccactaaatgtgcatgtatcatctgtccctcctagtgtctccttatagaaatggggacctgggaacaggtgcaaaatatatgctgatacactggctactggaattagcttaaagtaataaactcccctttttctgtgactcaggagtctcatgtcttctgccaccaaccttgaagttgggtcagtctaacttgttaagttacaaatagggtagaacctcagacctttcgcaattcttaataaggtgatgtatgccacatttgggccaaggcagagaaaaaatgtgtatggttcccctcacctcccatcccccttttaaactgctattggatggaagcccacaatgaaaagagttgtttctctgacagccctctgcataacaggaaaaactggttgttctattaggtaagacagcaatcattttttagaaagctaacttactgaagtagggtttatttgctaccatggtgggaggtttgtgcattaatttgactaagaatgacagactaacaaatgtgagtagccagaaatcacacacatcacaccttctgaaaatgtctgtggaaccaactgcagatgaacacataggccagtacgtcttggtaggcagcacaggtggtgattcccttactcatctgctatggtgtataaacttcaacttcaaggcctaaaagcctcacaaccccataattggaggtgttctgagtttgtcttgctctgctaggtctctgagcattactctggtatgtgatgaccaatggaagacttgtctagctaccattggttttgagtcttttctagtacatgttgttcctattggtctagtatatctgctgtctgagcattcacctttgttcacttactatttcacacatttctagaattactctatcaacatagaaatagtattggatgatggatgccactccaactagttatgaacaaatgtggcactttatcagtagttgagcaacaggctaagaaacagtaaacacttcaggacagaaggttggataacttattatgtggcaaatatttcataaaattgctgtgtgccataatgtgaaaagcagaccaagattttactgtacctgtatttcttgggaaattttgttctaaaaattaaaaacatttgtgtatgttggctttactccctctccctgtaaaatgggactttaagaaataacagttcatgcaataactatctgctttgatagctgaaatgggaaagaatagagaaatttaccgcttagcaagattgagaaaatctacagacaagaagggtaaaacaagacagagaacaagttaagggcaacaaatacccagtaaagtttcccagttaatctaagtgactcagtccagaagcaaagatcagataaggttttactttgcctttcaagtgaagtgttttaggtggtctcaaaatagccaccattaggttgagagtgaaaggtgtggaagggagaaaacgaggtaagacagacttgagaattatttctaacaaaggactttcatatagttcctggtacttagcattgattagaagcaaaagcctccccaagtcacaggaaatttttctggggaaatttgataactagttgtatgtatcaacttgactggatattactttctcctacttgatgattcagacactcggactgtttctaaatttttgtgcaaatagttcccaaggattcagggacttctgttcccagctcaaaatctgggatctcactccctgattctgtattctagcaactccaacacagatcctacactgtcatgatcctgcgtttcagtaactagcagacaactatatgcccttatcccctttcccatccattttatagttacagtgcagggacaagacatccatgataaaaagcaaaacaaatatgccacctgaatattcagagaagggaagaataagaaaacacaccaactccagttcaaggcaaaggggcaatcctataggagggcgtcatgaagccctgctctggcaggggtggaagttcctgagtagacagtaattctgctctctgaaaggatcattgttctctgtgagccttcattgcactctacatagatttcctagttcatgttcctgttagagtcataggtgaggtggatgtctacaagagtatttaaggaggaaatcaaaacctgacttgatagactgagtaaagatcacccttcaccagtgcaggtgggcgtcattcaatccacagagaccctgaacagaacaaaaaggtgaaggaaggaagaattcacactctctttttcagccaggacatctgtcttctgctcttggacatcagtgctcctgattcccaggccttaggacttgagtcaggacttttatcattggccctccattcagttcttggattgcaagtataccagcagcttttctaagcctctagcttgcagacaacagaccatgtgacttctcagcctccagaagaatgtgagccaatccctcattaaaaaatctttttgtatatatcgctctatatatgtcctaacaattctgtttctctggagaaccgtagcaataaaaaaaaatcaaaatccctgaagtagaaagcctttgatatttgttcttgaactgctatcagatcccaaaacacacacaagcacaaagcatgctagtaaagccccacagccatcacagagggaataacgccaacatccacctcacctctgactctaacaggaacatgaactaggaaatctatgcagagtgcaatgaaggctcacagagaacaatgatcctttcagagagcagaattactgtctactcaggaacttccacccctgccagagcagggcttcatgacgccctcctataggattgcccctttgccttgaactggagttggtgtgttttcttattcttcccttctctgaatattcaggtggcatatttgttttgctttttgtcatggatgtcttatccctgcgctgtaactatataatggatggggaggggagataagggcatatagttgtctgctagttactgaaacgcaggatcatgacagtgtaggatctgtgttggagttgctagaatacagaatcggggagtgagatcccagattttgagctgggaacagaagtccctgaatccttgggaactatttgcacaaaaatttagaaacagtccgagtgcctgaatcatcaagtaggagaaagtaatatccacaagttatgatagtgtaaaattctattgtgttaagccactgaaatttgcaggtttctttcttaaaatactagtgttatccttagttggcaattctcaaattagtattcattttcagcacctaaagagccttttcagactttttatttataatgacctcttattaaattttactgtctgtttatgttttatatgtgtatctttgcattacatataagaagagaactattctccctccacaccagaatcatttttttttttgccccttgagggcgcaattgcctgattgagaacaggtgcccagaatgatgctaagatgtgttccctctcctgcccacctctctttcctctcttaaggttcccatctatcactgcacactaatcatgttcaccttctttctatttcttgaacatgaaaagctctttctaacctgaaggtcttttttatttgtttactcttttccttgaaaacttttaatttcagtctttgtactgctgacttcctctaattttttgtgatatttcttaacattttcttaaatgttaccttttcagagaaacctgtttctaaggtgatctactcttgttattcttagtattctgttttctttcatagcacttatgataattttaataatatatttgactattttgatatgtacttattcttatgcccgtcactcactacaagacactccatatatacttggaattaatatacttgctaattaatactgaagagcagacataaaaatgataagttaatgaataaagcaagcaagcaagaaagaaaggaatcaatagcaggtcaattccactatttttaaattaaccttcttttcactccatttcctcttttgctgtctagagttcaaagttcatatttggttttgctaaactttagagaaatttctcattaacctgtgaaagaaatgttaagtataaaatttcactaaagctgaacaagttcatgctcaccacttcaggtccatctggtagcttcttgcccagatttccttctcctgaacttctcatccagaactttcaagatgttttccagaggcccacgataatacttactaataaatatgttacaaaagttagtgaccacatgtactacctgaaggtgtttccaaggagaagatttcccctctccactgtctttcaaggccacccctcagtgaagttgtagtgttcagtcaacccttctgtgaaccaggctttagtttccttcttcctttttcattcttctattagctggtcactggggcttcacacaaaggcacaggtgtaggtggagatagatatgttgatgtagagtaggtggtggatggggtggttcctacttgtttatgtaatttacttatgccatccagatctgcttgggcttaatcccacatataccactttcaatttatactggtttgttgctaggtggcctacatttatgacatgatgagtctgacaatgattagtgtatgatgggcagctttagtcatatggtcgtttgatgccttacaatcagatattcagtttccagtaaggcccccaatccagaaattgtactgcaagtggtttacaattccctgctgaagaggaaggtcttattccaaaccctagtggcctgtgctgtaactttcttattagagtactctgaggactccacacaatgttcttttctacagcagagctcagaatattatagcctacgggacaaatctgactcagggcctggttttgtagttaaggttttattggaacatagacacacttatttgtttacatattgtctgtggttccatttgcactaccaaggcagagttgaataattttgggataatggtagcgttgaatagttgtactacatcagcagagtgtagtcattgcagcaaagaccctaaggccttcaaagcctaaaatatttactacctggccatttacagaaacattctgctgactcctgctctataacttgttggatctgccagatcatatcacccaagtggtaaggctgtttctacaacagcgtacaactgctgctaagctgacttcggctctagacccactcaaaattggcagtgttctaagtcacctgataaatgaatcaaagcagtacgccctagtatggtatgtgttatttcaaaaatctgcaaatgtctgccaagcattgcaacctttcagtagcaggaagttctgatgtcctggcatgcaccatatcattggatccttaaaagtttcattaatatggcaggtcccttgctctagcaagcagtcaacttaaaaaggcatacatgatccggcgcagttgctcacacctgtaatcccagcactttggaaggccgaggtgtgttggatcacctgaggtcaggggttcaagaccagcctggccaacatggtgaaaactcatctctaccaaaaatacaaaaagtagctgggcatggtggcagatgcctgtaatcccagttactcgggaggctgaggcaggagaattgcttgaactcgggaggcgaggttgcagtgagccgagatcgcgccactgcgctccagcctgggcgacagagagaaatgctgtttcaacaacaacaacaatgacaaaaacaaaggcatacagagtatctgttacttcctgcttcccaaagtcttgaaaaagagtcagagagattgtccatagaatgtccagataatcaagatcttttcagactacagtgtgacgatgtagcagagtcaataccatcctgaggcgagatcatgtgctatttactttccatccaaatgaatgcttctgattctttttctgacagggaataaaattaaattcattcactaaattaatagctactatatgaattttctgcggctgctgtgactatggcaacagtagcttaaaacaacacaaatttctcatctcgtgattctatagatcagaagtctgatatagatctctctgagctaagatcaaagagttggcaaagtgcattcttttctggagtctgtagggaagactcctttcctatgccttttccacccactttccttggcacatggcctctttctccatccttaaagccagcaatgtttggccagttctcacaatgccgtctctttggttctctctccctattcactcttctgcatttaaggacccttgagattatattaggcacacacagataatccaagataatcttcctattttaaggtctgatgtttagtaactttaattccatctacatcgttaattttcctttgccatgtaacctaacatatccacaggtttcagagagcaggacgtagacatctttgtagtgctgttactgcgtctgccacaactacatatcaagtatggagtctgtgttgccttcttgtaggaaatatgctaaagcagctgtgaaaatgagtgtgccacttggttaaagatatgaaacttcactttcaattgccatgacgtatctaatttgttataggccagtattggtgaattaaatgaggataagaattcagatcacaaaacttattttttaaaagtctttgagtttggcatcaatttctaccatttggcatgtaatgcagtagtgtttctgattttctatcctggataggttgaagaggcagtatcagagaggtctgcttatttttttctataataatgtttcttataccacagagcagggaaccaatgtgagggttctgctaagtatatcaatgttagcacaggcagggattatgaaaacaatagaaggaactgctcctatgtatacttctggtggcatcaggatccttcaatataacaatctgatttagcttccaatctttgttaataaaatttctgaaaaggagatatacctgctttgtcatgaaagatagttctctatggagatatgagtaataccgaacacactgttaactatgtacattgtgggaggcaggattctaagatggcccccaagattccttccccctggtgtatatacctttgtatgtttccctcctctttaatatgggcagaacctgtaaatatgataggatttcacgcttgtgaataggttactaatcagtcaactttgaattaatcgaaagggagattctctgagtgggcttaatctatcgctgaccccttaagagggattggaaccttcctgcagtctaagagattggaaatgtgggaggccctatggagggggccaggttagctgggtcctgagggcagccttgtgaactaggagcaacccctgactgagcagccaagaaaatagaatgtcagtcctacaatcacagggaactaaattctgccaacaccttgcatgagtttagatgaggacctctagatcctattgagtctaagtaaacaccttgagtttggtctggtgaggccctgagcagtgggcccagggaatccatgcctggactcctaacagatagaaactgggagattagaaatttgtgttaagatattaagtttgtagtagtttgttttgcagaaatagaaagctaatacacatttatacatttagcaagtatttataatattcctgcgaatgaactaaacaaagtattataaaaagttccactaaaattaaccaaaatagatttgacattttgtgtatgactctatgtggacaaaatcaattagaagacagttcgcttgtctgtttggggttaagaatgtgtgtatagcattttaatttattttctatttatgagaaatctaattacgattatcataatcgattcaatcatggcacttctttgtggtggtctttatgagcatgtgaaatagctgctttctattttcatatacttcattctgatgcatatttactgaagtaataatgtctgaagatctattttgtattttaattaccagcattttcttgcataatgagtgtaatcttttatacttatgctcaattacgattttgagataaaaatgtctatttacttctggcttcaaggaaaatatttttccttctcaactgttacaggcatagttcaaagaaaacctggtatcattttattggttctaagtttataaataaatatatgatatcctatttatatcgatttatagatatagttttcattctataccctacttagatgtatttgttgttttattttgcttgcttttacataaaactttacttttaaactgtttttcttacctatttaaaaatttttagccaagaattgatatgaaatttacaggcttccactgcaattgttggcttcaccccctaatctcccgcctggtgatgataggagtaataactaacgcaggtgacctaccaaggtagcacaataagtgggagaaccaggttgtctgaaacatagctcactaatttttataccacattggcagctattttttcagatatttataaacatgtgtagatatttatagaaagcaaatgaatgccagagaaaattcacttatctgttcttgaaagctaacatgctacataaaagaaaacgtcctttggaaattgcaatgctgatgtaaaacatagcaaaacaaaacaacacaaaaacaaaatttagagtttccaagtaaagtctatcaatcagaccacatcatgtgaaatatctgaggtgttctggaaactcagtaatattaaatactgattatatggagtatacttcatagcctctaattcatcatcctgctcattcattgtatatagacatttcttacttcatctgaattggtgtcctttcttctccaaaatgtacttagatggaaatacagatataagcaaatgtgtgtatgtgtgtggtgtgtgtgtgtgtgtgtgtgtgtgtgtgtgtatgttgctgtgtctcaggaaagaattcatgtgactgagattttttatatatatcatgttggtaaggaatagaattgagctggaagtattgaaagagaagacattcaaagtggaaaagatgccatttttgaaggcacagatgggttaataactaaaagttcagagaaaataaacagcttattaacttctgtgaaaaagaggacaaactggggacaaacaagagataaaatcctttaagagtgtgtattggaatatatttagtgagagacttgaatcatttggcatttaaagtaatccccaaatgaataagatggagatgaacactaattctcaaacatgtagctgcaaacgggaatgtaggagggaatttttttaagttactaagcaatctttccaaaaaaatcacacatttcccctcatcgtttattccaagtcctcgtctcagctttggatttttccggatggctcaggcctaacgaaggtaaatgtggcctggatgatgggagtgggttttgtgggctgccctagctcccacatggtgctctgagagcggcacagcatgctgttacagagtgtggcccgagagccagtctcacacttctgatctctgtttaagtacctgttaatgtctgatcctgggaaaattatttaacctatcattcttcatctataaaatgtggattataggatccctcacagggctattatagggatcaaatgagattttctccttttgtgtttaatgtgttccatagtatagcaatcaacatatcagcttcccagaaaggaaaagacatgaaaattttaggaaggtagtataatttgaaatagtacagcataaaattatccaaagaagtatataaggtatgtcatagttactatatagaaaatagtaagttttcattcagatactttaaagcaaggaaactgacaattaccacctaatctggtcctgctaataaggtttttcattattttatcttctcttaaaagtgacacctatatgcatagacagacagtgacctcagtcacatcatcagaataatttataaacactgtactaagttatgtgttttttaagaacctgaaaaacacaaatgagggtgctatgtgcttcgttcttctaccaagcctgcaaatactattaatatctttgcatgtgtatatatttaaaatttatctcacatttttgacaaagtatacaaacattgaaagctttgcaagtttacagcatttgggagttaaggtagattctgaaagtcttcctattatgtaacaattgtttagcatcaacactaaactatattcagtacaaaccaaagatttaatcatagtccaagactattacattcattaaaattccactaatgaggaaccgctaaggcaatatttcattttgaaaaaagggaaagttccaatttcaattttaagtgaatttaaattagcatttaaatatgttctataaacatgtgtctgactgagttatgatcagtatgatcgttactgtagtgattattatgtgccctttagtgagcactcactgtgtattgaaagccttgcaaaacacagtatgtttaattctgcagatttctgatgacttttttctcacgagaacacagaatacattataatatctttcctcagccctaacacatagtaataaaaaattaaaggaattttatttttgttcctaacagctttgtctattcattgaaatttaagaaaccaggtaaatataattttctaaaattacatctaatggttggttggtttcctgtttgtcttgtgaattttatgggtttcattttgacactatatctttaaaaacctgaaaacatctaaaatattgatttttaatctggttatttgattagtgttctttctaaactgtcacttttttctgctatatattatttatatttcataattttaattcaaacatatttctattaattttgaaaagacacaaaccaagtgctgtaattatataatgtaattctgtaaaaacaatattaaatatcataattgaaatattattttgtgtattcaaaattgttttttactttggtaagattgacaaatatttttgttggtaatctttcagtgctttcgcttagttacatgccttggatatcaatgcatttttttccacaaaaccttattgaagagctgaaacaaccacattcaagaaccacttcccttgttcctgtgaaggactataaaaaacaaattgagaaataaacagatacgtcacagaattaatattattaaacaccaaacactattcagtattaaatactgtagttggaagtttgttaacttgggtatttcttcaaagtgaggaacttttgctaacgtcagatcagttgatcacaatcactgtctttcaaagggctttgtttaaaaaagaaatctttctaaatcttgctattgtaaatcattttaatgaaatagtgatcgcgagttttatgaataaaatactttgtggtacaagatattaggccaaaactccacaaattcaacatataacaattcaataaaattttgaattgtgttaatgttatttgttattttgtgtctataatcgctaattactgcattgtagtgcatcctttttaacatattaatgaaaataagtaacataaaggtacaggcaatgacattatatgaagtgtctgcaaaaagtttatgaaaaaaaaatatatatgaggagaaaactatgcataaatttcagaaatgttttgtacccaaataaacttgtactaacttgttataacatgtctgagtaggatctaatttgagacactaagaaggataaggcatcagtgagaaaagagcccctagagctcctatcttagcaacacgaattctgctagcattgaagcaagaacagacatccaatttatggtgaggcttgagtagaagaagggcaaaattactgatgctttatgaaaagtttagggggacaatgcctcaaagatatcagcagcttataaatagagaactcattttaagaagggacaagattatgttgaagatgatgcctgcagcagcagaccatccatatcaatttgtgaggaaacaaattcgtcttgtgtgtgccctacttgaaaagaactgatgattaataacagaaacaataggtgacaccatagacatctcaaattgttcagcttacgaaattcttttttttttttttttttttttttgagacagagtttcactctcatcacccaggctggagtgcaatggcacggtctcggttcactgcaacctccacctcctggatttgagcgattctcctgcctcagcctcccaagtagttgggattacaggtgcctgccaccataccccggcttacataattcttatacagttatgtagtgaaatttgtgtttgccaaaagttaagctttaaactttagtaacttaaaaaatgtgaatgctacaattcaaactttttaaaaattatattttataaacaattttgtaaactttaaataataatgtttattttcaaacaactgtcatctttgatttaaagggctgaaaaaataagggtaaaatttaatttacaaaatcaaataagtgaaaaataaatatatataattaagttttaagtgaactttgtgtaaatttgtaacattgatactttgggagatgctacagctgaaaatagcataagattttggagacagcgtctacatttctaaaacatatttttcctttaagtagaaattttacctcaaagtagatagatgtctaccaaattgctcatattatcagatatgtcttaaatcttatttggataacttcaacagatatttgtagtttaactttttattgagataatggtagattcacatgcaatggtagaaaaataatagagaataaaataataataatgtctcagtcttcccccatccccaatgataatattttgcaagactacactataatatcacaacctgaatattgtcattgatttaatccacctgtctggttcagatttctcaaattttactgtgtcatttgtgggtgtatgtatttaattcaatatagttttctcatgagtcatttcatatatgattaccgtagtcaagatacttaacggttctagcattacaaggatgctatgttttgcccttttataaccatgccacgtgccttctgcttccacccactgctgcccaattcatttcaaaaacgttgtataaatggagtcatccatatgtaaatgttgtggattggctcttttttgttgttcttaattgattattctattggtaagacttctggtaaacagaaggcaattattagtagttaagttttgggggagccaaaagttatatgtgggtttttgactgtgtggagggttggtgcccataacctccattttttttttctttttcaacttctattttagaatcagggggcgcatgtgcaagtttgttacttgggtttgctgcatgatgctgcggtttggagcacaaatgatcccattaaccagctatggagtataatacccaacactttttcaactcttgtgcccctccacacctcccctctcaagcagtccccagtgtctattgttagcattgtggattggctttttcaatcagcataattccctggagagtcatgcaagttgtgtgtatactttttgtgactgagtagtattccctagaatgtatgtaccagagttttttaaccattctcttgttgaaggacatctgagttgatttcagtgtttggctattacagataaagcagctattaaatgtatggacaggttttcatgtaaatagacatttttcatttctggagaaaaagcccaagagaacaattgctggatcatatggtaattgcttgtttaattttattttatagccctgcccaactgtcttccagagtggttatatcattttacatttcttccagcagtgtgtgagtaatacagtttctcagccttaccaacttgtgttatcactattttttaattcattcagtgataaatagataatcggataggtgtgttgcaatatctcacttgtggttttcatttgcatttctctaatggcaaacaatgtcaaaacactgatcatcttttcatgtgcttattttccacctgtatgtcctcttcagtgaaatatctgctcatatttgaagcccattgtctttttaaggtatattgttcatgttttcaccattgggttttgagaggtctttccatattctaaataataggttttctgtccgatatgtgatttgtaaatattatctcctggactgtagctgttttcttttcatcttcagatgggctttcaagaacaaaagtcttcaagtttgatgaagtccaatttatttgcttttattttacgaatcatacttttggtgtcaagtgtaacaattctttgcctagctctagatctcaattactttctttaatttttttcaaaaaaagcttatcgttttatgttttacttttaagactgtaatccattttgttagttttgaataatagatgagatttaagtcaaattttctttttaaaaaaatttttgcctatgtatgtcaaatttctccagcactatttattaaaagagctattctttcttcactgaattgctgttgctcctttgtgacaaatcacttaggcatttttgtatgagtctatttttttcattctcttttctcttctgttgttcaataggtctctttcttcccactccacactatcttgcttactgtagctatataggaagctttaatattggggagagttattcttcccatttcattcttctttgtcaaaattgcatttgagggcctatgactttccaaataaattttagaataagcttttctatgtcttaaaaaagaaaatattgctgggactttgttaagaattgcattatacctataaatcaatttgagaagaattgacatccttattatgttgagtctttcaatccataaacatggtatgtctctccctttgtttaaatttctttattaatttatcaatgtattataatttttggcatacagatcttctacatgttttattaattatatatctatcaagttcacttttagagcagttgtaaatagtattgtggttttcatttttgcctatgttcattgttaatatagagagatatgattgatctttgtgtgttgatcttatattttgtgaccttgctagactcatgtattagttatagaaggtttttttttttagatttggaagatactttgggatagtctatgtagataatcttgttatctgcaaatagaaagttttattttttctcttttcaataagtatgccttttatttctacgtcctgcctattccagtgactacaacatctatgccaaataagagcagtgagagataatatcacttcttggtttctatcttagggaaaaagcatgcagttttaattattatattcactatagatatttgtatacattctctttatcaagttgagatatgttacctaacttgttgagagttttcattatgaatgagtattggattttgtcaaatgctttttctacatcagttgagatgagcataggaattttttcctttagctttttggattataattgatttttaaatgctgaaccagccttgcatacctggtaaatcccacttagtcatggtgtataattcatttttacactgttgaatttttgttgctaatattttgtggagaatgtttccatctaacctcatgaaatgtattggcatgtagttttctttttttgtactgcctttttctggctttggtatcagaataatactggctcatcaaattagtttgaaaatgttccttcctctttcattttttctggaagatatgtataaaattgctgttaattctttaaagagttgatacaattattcagttaaactatttaaacctggaaatttatttttctggctctttcaaattacaaattaaatttcatgaatggtaatagaaattattcacatgatctcattgtggttgatttttggtttgtggtttatgagaaattgatccatttttctaagttgtcaaattcatgagcacaagctcgtttgcagtatttgataattatctttttaaaggccataggatctgtaataatcccttatttcattcctgatattgcttatttctatctcttctttttttatgtcagtcttgctagaggtttattactttttttcaaagaacaagctttttattttactgattttctctactgtttttctacatcttttctgagtgacctgttgtcaaagactcggttctgcttgcttcatattagggtgctgcacactgtgagtgattacacattaaggaataaaaaataaaatgaggacctaaaagagctatgaagaaatttttagaaagggagagcagtttcttttgcaattcacttgggtcgagcttctgaaagaaagtcaattttaaagctatcgagcactgtattagtctctttgtgtgggtgtgtatgtgtgtgtgcatacggaaaaaaattatatacagaaacagatacatcatatattatatatagatgctactgaaacattaaagaattaaatagacacttaatttgggaatttggataaacttcctgtgttaaataattttttttgtgatgagttttgaaagactggaagggttttaagagatatggaaatgaattctaaagaagaaaacattgtgagaaaaaagttaaggatttggggaaacatagaaacagattgaagtgctgttgaaaggtaatttagtatttttgaagatactatttgagtgataagaatacaaacaggggccgggcatggtggctcacagctgtaatcccagcactttgggaggccgaggcgggcagatcacttgaggtcaggcattcgagaccagcctggccaacatggtgaaaacccatctctactaaaaatacaaaaaactagccaggcatggtggcgggcacctgtagtcccaaccacttgggaggctgaggcaggagaatcgcttgatcccaggagttggaggttgcagcaagccaagatcacaccactgcactccagcctgggtgccagcctgagtgacagagcaagactctgtctccaaaaaagaaaaaaaaaaaaaaaagaaaacacaaacagggagataatcaaggagataatggagagttggagggtgtccttaaatgtcaattaataatttaggttttattttgttggccataagccaaataggtataggttacataatgttcaaagaatatatgagagtctgaggatttctattcttgaagacaaaatgtgtaagtgaaatatctgttcctgaaagtgaaaaggtacaagacttaatgaagtgtaactaataactaataaatacgagtactccttggttttacggccattggatattctcttttgagaagtgaccgtgcaagtacttagcccaattttctattgtctttttcactgatttgaaggagaactgtctgttctggatgtgagttcttttcttttcttttttttttttttttagtctgttacatttatgggtttgtgagtgttctggaaaattgcagtatgtgtgaagaccaatttccttgctggcattgcatgcatccaaatattaatgcacagaggcacagaattagagcaacaagaaagcatattccaacactagcatgccccatacccccttttgattgcttgtttgcttagtacttcatatatgtgttttgtaagtattttgtccacatttgtggcttttattattttaagattttgctttgatgaagagaatctttcagtttaaatgtagtccagtttattcagtttttctttcaaatttagctgtttttcattttttttaacaaaattatttgcctactcaaaggtcctaacattgtttcccatgttttcctccaagagttttattgatttatctttgctatttagatctgaaatcaatcagggtcagaagcagaagaaacaggaatgagaaccctagggaacaaaaagaaaacaaataataaaatgaaagacttaatccctagttattaataactacttgataaatacttatttaactggttaatatattaacttgaacttaaatatagcaaaagcagaaattggcagaacagataaaaattttttgacccaactacatactttatttaaaaaactcacttacaaacgtactgacaaatgtaggcagaaaataagggatgaaaaatgattcatcatgcaaatgcaaatattaactaaaaaggaatgaataaatacattaacatcagataaatcagacttcagacataagaaaattactaggaaaaagagacatcacaagatgataaaatgatcaattcaccaaatacatatagaaatctcaagtgtatcaatactgctattgaccaaattgtgttgcctgaaacagtggtgttaaagacccatcctcaatgtggtggtatttggaataagtaagtaaacaaagttaaatgaaatcactttgataggatgagtgtcctcacaagaggagaaaccagagagctctctctctctctctctcccatatgaagaaatagtgagaaggttgctatctacaagccagtaagagagccctcatcacaaaccaaattggctagcaccttgatcttggacttacaagcctctagaattgtgagaaaatacatatgttttttggtcacacagtctatgacattttgttagagcagttcaaacagactaagaaaaatagaaaaagacgaggcttaaaaatacaggaagcaaaaactaatagaggttaaaggaggactagacaaacctacttatagttaagaactgaattcaggtgcggtggctcatgcctgtaatcccaatactttggggggccgaggtgggtggatcacctgaggtcaggagttcaagatcagcctggccaacatggtgaaaccccgtctcaactaaaaatataaaaactagctgggtgtggtgctgggtgcctgtaatcccagctactcgggaggctgaggcaggagaattgcttgaacccggatggaggttgctatgagctgacatggtgccactgtactctagcctcggtgacagtgagactccatctcaaaaaaaaaaaaaaaaagaacaaaaaagaacactaccactaccaactaacactaccaatgaattaacatttatagaacactccacatagcaacagctgaatgtttattcttctccagtgcccacagcacattacccaaagtaagcataccttggttcataaaacctcaatcaatttaaaagaattaaaatatttgagataggttctcttaccatagtggaaacaattagaaaccaatattagagagacgtcagaaaaatctttataaacgtggaaattaaacaacacaatatttaatatctcatggataaagaagtctttatacgtattaaaataaaattaagtacaaaatatcaaaatttgtaggatacaattagagcaatgctaagaaacaaatttgaaacactaaatttttactgtgatggtttattttttgtgtcaacttgactaggataagggatgccagatagctcgtaaaatattatttctgggcatgtttgtgagggtgtttccagaagagattaccaattttatcagcaaattgaaagagaatgccacctttactaatgtggatggtcatcacgcagtccattgagggcctgaagagtacaacaaggtggagaaagagtgaattcactctcttcacttgaactaaaacatctatcttctcttgatcagttgaaaaatttatctctcagatgcattcaattgaataatttatccctggatatttgtactaaaacctgttaaaaccaagagtctatacatcatattagttaacaggaagttgttctgatatatacagtaaaaggaaatggaaagcattattttcaaatcaatcacacaacataaattcgatcaaatatgagtctatcatattatgatgaactctgatggtcttgcaattgcttttatattttttccaataggacttgatatttggggtatgcacatcaagaggtgaaatgaaatggaagctgggatcattatgtatagactgatcatgttagaaacaaatgagagactgaatgttactatgggaaacccataagtcagattaaatgggagagccaggttgaactatgcatcacaaaataagcagcaaagttgggcagaatggtcaaataaccaacagctagctgacgggtagtatttatgataccaaaaccccatatttccctctccagaacatgaccatgataatagttgagtttgtggctaaaacaatacttgtcaatttgtaagtaaggacctggaccaccaatctgtatcagatgtagttcaaaataatacttgcatactttgctatagaaattgtagatgtcaactatagtatgggttgaaattccagtaatagcaatagccattttgtgtgtgactttcattcaccataagaatagatgatgaagccacattttcagggagacattgaattttgtgaaaaagattcctttcaaagagagacccacgacaattgtcaatttcagagagtacatttcctaaatagccatctttgcactgatatcataccatgtaccataaaggttagtgacaaaaagaacattcaggagccacatataacaaattaaaaacactaaaaagttttgaatttgacccacaagggttgatcacaattgattaatttgatgcaccacaattgaggaatttgattcacagggacaaattgttcaaatcatcttcttctcctgccttcggactcctggtgctcttggttctcaagcctttgcacttggacaggaacctacaccatcagcctttgtggtttttaagctctttcaactccaatcggatcttataccattggctcctcctggttctcaggcctatgggtttgggttgcaatgacaacactggttttcctgggcctccaccttgcagagagaagatagtgggacttctcagcctccataattgtgtgagccaatacctcacagtaaatctctttttgtattgattctgtttctttggaaatccctaagtaacacagttacattagaacagagatctcataactataatctatttttgcctcaggaaatgagttaaaaagagcaaaataaacccaagcagacaaaagtaaggaaataataaagataaaagcagaaataaatgacattgaaacagaaaaacaataaagaagatgatacaaaaaactcattcttcaaataaaatcaatcaatacaactgataaatcttcagcaagactgataaaaataaaaagagagaaaacacattattagtatcaggcactaagcagggatattataaaatatctggcaactattaaagagataagggaggccgggtgtggtggctcacgcctgtaatcccagcactttgggaggccgaggtggacggatcacgaggtcaggagatcgagaccatcctggctaacacagtgaaaccccgtctctactaaaaatacaaaaaaattagccgagcgtggttgcaggctcctgtagtctcagctacttgggaggctgagggaggagaatggcctgaaccctggaggcggagcttgcagtgagccgagatcccgccactgcactccagcctgggcgacagagcgagactccgtctcaaaaaaaaaaaaaaaaaaaacagagataaaggaataccatgaacaactttacactcatcaacttaactctttagaagaaatgaacaaattattcaaaaactaaacactagcagaaatcagccaggtgaaagagataaaagaaagagtcctataaccattaaataaattgaattcataattagaatatctccatcccccaacattcaggcccagacgttctggagaattttaccaaacatttaagaatttacaccaattttacataatctcttaaaaggcaaaaagattaggaggtaatacttctcgagttattttatggggtcaatactatcctgatagtaaaagcaagtaaagatagcacaaaagtctaaaaccacaggccaatatctctcaggaacatagacacaacaatcctcaacaaaatattagaaatcacatccaagaatggatgcttaaaagtatatattatgatcaaatgagattattgcagttattcaagcctgaatcaacatttgaaaacggatcaatgtaatttatcatatcaatatgctaaagaagaacaatcataggatcataaattgacacagaaaaaccatttttaacaaattcaacaaccattcatgcaaaaagtcaacaaacaaggaagagatgaatttcttaaacctcataatttcaaaaaccctacagctgacatcatagctaatgatgaaaaactgcacattttcctgtaagattgtgaataaggcaaaaatacctactctcagcatgcctattgaacatagtactgaaagttctagcctctccaataggcaggaaaataatttaaaaacacgcagattgactagtcatttagcattaggtatatctcctaatgctgtccctctcccctccccccaccccacaacagtccccagagtgtgatgttccccttcctgtgtccatgtgttctcattgttcaattcccacctatgagtgagaacatgcggtgtttggttttttgtccttgcgatagtttgctgagaatgatggtctccagtttcatccatgtccctacaaaggacatgaactcttcattttttatggctgcatagtattccatggtgtatatgtgccacattttcttaatctagtctattgttgttggacatttgggttggttccaagactttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgacttctacaatggttgaactagtttaccaacatggcacatgtatacatatgtaacaaacccgcacattgtgcacatgtaccctaaaacttaaagtagaataataataataaaaaacatgcagattgaaaaggcagaaataaacttgtctttatttgcaaatatcaaaattatcaacactaaaaaccctaagaaatctaccaaaaatctcataaatactgagttcagcaaatcacaggacacatacaaatcaacaactgaaatgaatcacatttctttaatttctaaaattaaaaacacaatacagtagtatttataactactccaaagataatgaaatatataggtatacacttggcaaaacatgtcccaggactttgtgctgaaaattccagaatgctgttggaagaaatgaaaaagacctaaataaatagaaatacacagcatttatgaaagagaaaactcaacatattaatcatgccagttgtctacaaattgatctatgtatttgatgctattcctatcaaaatctcagcaagaattgtatagatgtagagaagcttattctaaaatatatatggaaaggaaagatctataaatagccaaaacagtttgaaaaagaacaaaatgaatgattaactcttcccagtgttaatgggaaattataccaattttatataacattccctttaacattgggaagagttaatcatttgttttgttctttttcaaattgttttggctatttataactcttcctaatgaggagagtatgttactggaataggtataaacacagataaattggagcaaattacagaatctaaaaatatactgacatcaagatgcccagttaaattttgactaaggagcaaaagttatttaatgaagtaagaatagcatttttaataagtggtactgaaacaattgaacactgataggaaaataaaatgaacttcggtttaaaccttctatcttaaaattatctcaaagtggaccaaacacttaaatgttaaatttaaaagtataaaaaatgtaggataaaatgggaaaatcttttggatctaggattgggcagagtttttagacttaacattaaaagtgtaatcaattaaaagaaactttcataaattgcacctcaaaatagaaaaagaaaagaatactttattttgcaaaagatccagttaaaagtttagggcattgccctactggcttttacctgggttattcataatcagagatacaatttgtttaggtaatgcaacccttttttggtagatttccccagcatatatttctaatgtttgaaccaataaatgctatcacttgggtattttcagtgcataaattttacacaaggttatttagagcagcatgaaataccatagtacagtttgagatagccaatatgttttagtttcatcaggagagtttgttttaaataaatgatttctactcagaatcaatgtgcacaaattttaataatattaattgtgttacaacaactaataacttctttttgtttaatagtcaggtagaatatagaattcattataggcttgtaccaaaataactgaatttcttggatattactttataccctgtaagtaggtattcatatatttttgttttaaattattgcagtgtacatggaatactatgcagccataaagaagaataggaccatgtattttgcagggacatgaatggagctggaggccattatccttagcaaactaacacaggaacagacgaccaaataccatatgttctcactaaaaagtgggaactaaatgggaacacatggatacatagaggggaacaacacacactgacgcttattggagggtagaaggtggaggggggatcgggataaataactaaggagtagtaggtttaatacctgcgtaatgaaataatttatacaacaaaccaatatttattggcagtaaatagataattatatggccatattttaaaattttcttagcaactttagtaaatactccatttaatgttcagaaacatgctacaaatttgtgacactgtctttttggttttcatccaaaatctaatgcattcacacattcttatcagtgtgtgatggactgaatgttcctgtaccacaaaattcatatgctgaaaccctaatcatgctgaaaccctaatcttgctgaaaccctaatcttcaatgtggtgttatttggagatggagctttggggaagtaatgatgtcattagggtggagtcctcgtgatgggattagtgacctgataggaagagaggggaagagaacttgcttcctctttctgctcttggccaggtgaggatatatggagaagaggactgtctgcaaaccaggaagaggggcctccccaagtatggcatctgtgggctgcttggtcttagacgtcccaactttcagaactgtgagaaacaaatatttgttatttaagccacccagtctgtggtaatttgttatagcagcccaagcagactataacatagtgtgatattttaaaaacacgttttatggaatatataagcaaatcttcagtaataactatgtaatgatttttaaatgtctgtcctatattaaaatttttcaactttcatatatatcaaattctgtagatttaagtaaatagaaatgagcattaaatataaaagtatatgtaattctgtctgactggaatcacagacacacagacatttaaaatgttacttccaatagcattagcttcctgatctatatgaatttaggactatttgtagacttacagtaaacttaaaattatcctaaatgaaagtgattggcataggataaatacttaaacacgttaattgccttccctttagaaaacagagagatatatattcaccctcacacagacaaacacacatcagcaaagaaaaccaatgtctccacatagatgtttttgcttcccagacccaaaacatctggaggtgaaatgattgacattgaaatgtaacaattcctttaagggagaaaaagctttgggaatggtgttttttcacactaaaagagatattatatacacttactgtaatcagggttgcaaaattaagaatatgattatattagtttcctatttctgctgtaacaagttagcacagagcagtttaaaacaacacaaatgtttactttcctacagttccggagttaagtctgaagtaagtgttacaaggctaaaatcaagatctcagcaggagtgattgcttctggaggctccagaggatagcacctgtcctcaccttgtccagcttctagaggcagattgtggccccttcctatatcttcaagccagctacgtagcatttttttttctctttaaccaactgctttgttttataaataccttgtgattatattggagccatgcaggaagccaagatgatctcccagttccaagatctttaagataatcgcattagcaaatcccttttgccatatagagtagcatattgactggttttagagattggaatgtggacatatttggggacgcattatttagtctttcacagttataacagagcttttttttttttttttttttttttttttgatgaagtcttgctctgtcgcccaggctggagggcagtggcatgatctcggctcatagcaacctctgcctcccgggttcaaacaattctcccgcctcagcctcctgagtagctgggattacaggcacgcgccaccatgcctggctaatttttctatttttagtagagacagggtttcaccatgttggtcaggctggtcttgaactcccaacctcgtgatttgcccccccaggcctcccaaagtgccgggattacaggcgtgagccactgtgcccagccaataacagagcttttttttttttcttcactatataatttgaagcaaaatgccccagtaatacatgaagaagctgcaggcattcagtgttctttcagtatcctttaagaaagatgaatagtcttttccctacatatactgacttcacaacaaacttattcattttttgagatgcaaattacttcaatgtttcatattgatctaaattagctccctccttgtttctaatttttgattagcagctggtagcaatgaaagcagagtagagcaggggtgtgtaagggtatgtgtgtgtgtgtgtgtgtgtgtgtgtgtgtgtgtaaaagcaaatgctgtcacttacagcaatgatagaagatacctttgtggaattcaagaatctgtgcatcttcattaatgctttctgtgtcagctaaacgtattcgccatcaactttaaagcagcctattttaggatgtcatctgttggcttcatagggaggttttagccaaattccccactttaatgatttttcgcttcccaggtcatcttactaatattgtgatacaccacaaaaattatagcatttctcgatataattcaatataataggatcactgtaatgctacaaagcccaggcattttcatttctcatgctttccccttggaatcatgttaagaggctagattataggcttttgaaattgcaattttgccatttgggaggtaaaagtaattggatgaactatagcaagagataacatattaaaaatttcattaccatactgtttcaactaatctctcttctgaataaaggagcatacatctctttctgattctttttaggtccctaaatgtggaggtcaaatatcaagtttaaagaaagtgaaaaacagcattatgtatttttcctagtctatataaaataacagaccaatttttttcttcactgccatcaaatatattttatagacaaatcttttaataaacctcaaatatcaaataaaatgttttcacatcataatttaaataataaaatttattaatagatgtgtttataagtgcttctgatttctgatcattattcttcatcaggcatttaggcattcaatttatgaggtttcctttaatctcagatgaaactaactctgtttttcgtgtctctgtctttattgttgatatgtcacatttgaggccatcactgaagctccttgttttctgtatcctctctgagggctcactgttgcttttatcccctcctacaatttcccccacagaatacctgctgatattcattcatttttttttcagtttttgtaaccacttatttagcaattgaaattgcctgtttactgttctttcaatatcagcctcatttatctgattattcctctgaaacttgaagaggttgtgagggtctagtgtgacatgttacaaggagcttgatctgggtgtatgtagctcttcatgctgttcctcagaataagtagcatagaggcccaaactagcttcaattcccaatgaggaattatgagtcagtcatggactggagtcctgggtcaggcgaaccagtccaagtaaaaagggccaagaaccaaatgcaaaaagattctgaattgtgaaagccagtgtgcaggaaagtgcagcacaaataaccagaatgctcaaaaattccttagattaaaagtgtaaagctgcagacatatctttttgggaaccaccattaagccctctatgatgcgggaaattcattaataaaaataatttattaatgcaaaagaagggaagaaatgagaagatgtggaacataaaagagtttagacaaatagaaaattatagtaaaatgacagatacaaagagatcagtaatccatcaaatgctagtggaactaatgtagaactaacacattaaaggtaaatgtggtgatgctggcttaaaaatatttctagttatgaaaccactttaattaaaatgaaagctaaaatgttagaaaggttatataaatttcaccactatataaatggtttcaccatttaacatgcctctgcagctttacaattttaatgggtattaagtgagtgtcagggtaggtttaggaaggaaggaggtccataggagtgcagtctcctgagtatatgctacacagcacaaccctagacccagggccattttttttcaaagcactacttcatcatttagtgctattgcattgttcagaaatcttacttggagaattaaatttaatgctagtcttgcacttgaaaatctttacaacatggctacaaaccatttcccaaaatgatgtcactatgctcaccagtgtaaacctttgtgacagcaaactcttcaatcacctttttttcaaagcagtccttacactttcttacttgttttaaactaatcttctaccacattttcttctctcagtcctcttctgccaatttatctctgattcattcatcctgatggttcaaatctcacctttataaagcatttctggatataattcaatataataggatctctgtatatggaatatatccattccttggtgatgtctgtttcttaggaaacaggcattccttaatcattcatttttttcaatataaaatatttattgaatgcccacagtgtcccaggtaactccatcaattactgggggtccgctggtgctttgatagaaaatgaagtcatatatcctaatagattaaaggaggatatctttcttaagtcgtggaatttatataacttttctaacattatagcttctgttttaattaaagtggtttcacaactagaaatatttttaaaccagcatcatcacatttacgtttaattttactattagctcctctaacatttgatgaattactgatctatttgcacctgtcattttactatgtattttctatttgtctgaaatgttttatggtccacatcctctcatttcttcccttattctgtattaataaattatttttattaatgtatttcccccattgtagacggcttactgtgggtccccaaaaagatgtgtctacctgctaatccctgaaaactgtgaatagttccttatctagaaaaggttttttgcagatctaattaagtatggaacttgagatgaggagattatcctacttatcaggtaggtcctgaatgtcatctcaagtgtccttataaaagagagacacagggagattaaacaagcacgtacaaaggagaaggtaacgtgaagacagagcaggagagatgtggccacaagacaaggagcgttgacagccgccagcaaatgaacaagacaaggaacaggttcttcctcagagtttccagagaggatatggccctttcaactcctggatttcagacttctggcctttaggactgtgaaagaataaatctttgctgttttaagacatcaaatttgccataatttgttatagcagccataaaaacttacatacccataaattgacttttaattgtattctttcatttcatagttattctagaaattgcaacacccattttaaactctttaacttattaaaatctaatatttctgtagctttgtgattttcttggaaatgctctgacctagaaatatttttctactgtgttttatttttatgttattttgtcaggctttttgaattctacatgtttttgactccacaaactactattaatattatttttgttttagtgaaaaagctcttcaaaaaaggcagatcatttatttgatgttaccttctttctggaattttggtactaattaagaagcattttgtaagtatagttgatatttttatctcccacagatgaatttattttacagtgttttattaacccataaagaatctgaagtcaaggaaaaataggttagtacagcttggttatattgtagtctactaagatttagctacattcataactgaaaaatagattgaaattatgtaatttcctgattttaattgttaagaagcaaaacaaaaccattcaacggctacataaatcgatataatttttaggagtctactgtgttccataacctatgcttggtactgggtggcaaacattataggaataactagctaagtgagcaacaattcttccttaaggtagatattaataaaagtggtccaattctaactcaccaagtatcatacccgtgattcattatatttgtaataagaattcattcaatgttagaatcaaaagccttagtagctttttgtattatcagaatgtttttattcctgtatcttttagtggtctacatagttttagttacagtttagtgctataggatttcttaaaaccctaactaaagatcaaaggctagctctagcaacccactattaaattatctacaatcatcacacatatataaactaatttacttgttatgtttttatgttctcatttgaaaatatggccaactctcttattgtttaaaggtatattgttttatgtgtttgaatttcttctatatacaattaacacattacatgatggtaattatgtagaatagagtgaaaaactggacatagaaagaattctttattcaatcacattttaattcaaaactcagctctgcctctgcccctcagtttgattttgacttacatattagaatgccctaagcctcagtttcttcacaggaaaaaatgaagacaacggataacataagattgttgcagggatggaggatgatggatatataaagtgaatcatataggacgtggttgcagtaaagcatgtaaagataatatttgtgtttcaataatttaaggaaggtgatatcacacacacccacacatacacacacacacacaaacactccttctgtttctcttaggcttattttggctacaagttccaaatattacatatgaattttcttattgttatataataattgtacatatttatggggcacacgtgatattttgatacacatacattgtgtaataatcaaaccagagtaattcagatagccaccatctcaaacatttatcctttacttgtgttgaaaatatgccaaatcttctcttctagctatttaaaaatatacaataaattattaagaactatattcatactactgtgctattgaacactagaaattattccttctatctaagtgtatttttgtgtccattaaccaatctctctctatcccccttcccccatagttcccagcctgtggtaaccatcattctattctctatctccatgagtcagtgtttttctaagccttcacatatgtgtgaatgatatatgtgtttatgttcctagctcattttacttaacatattgtcatccaggcacatatatgttgccaaaatgaaaagatttcgttattttttatggctgaatgatgttttattgtgtgtatatataccacactttctgtatctcttcattgactgagggacacttaggttgattccatatcttgagtactgtgaatagctctgtaataaatatgggagtgtagatagctctttgatatactgatttctgttcttttttggtatatatccagcagtaggattactgaatcatatggcagttcttttttaggtttttacatactctttacattcccacaaatagtgtatgaaaattcccctccttccacatccttactagcttctgtcactttttgtctgtttgataatggccattgttactggggtgacatgatatcttattgcagtttcgatttgcatttctatgattattggtaatgttgatcatttttttatatacctgcttctcatttgtatgtcttcttttgagaaatgtctatggggatcatttacccattttaaaattgtattatttgtttttgtttttgtttgttttttgcttctgaattggttgagctccttatatgtcttggttaagcccttgttgaattgatagtttgcggattttttttcccattctgtaggttgtcttctcctctgttgattgttttctttgctgtgcagaaactttttagcttgatgtaataccatctatctatttctgcttttgtgacctgtgctttttaggtcttaccccaaaaattctttgcccacaccaatgtcctgaagcattctccctgttttcttctagtagtttcatagttttgtgtcttacatttaagtatttaatccattttgagttgacttttgtatatggtgagagacaggggtctagtttcattcttctgcatgtgcatatccagttttccagtcccatttattgaagagactgtcttttccccaatgtatgttcttggcaactttgtctgaaatgagtcggctctaaatacaaaaacttatttctgtgttatcttttctgttccattggtctctattctgttccactggtctgtgtgtctatttttatgccatgctgttttggttactgtagttttgtagtatattttgaggtcaagtagtgtgatgcctcaagctttgttctttatgctcaggattgctttggctatttggagtcttttgtggttccatacaaacttcaggagagtttttcctatttctggaagaatttcattgatattttggtaatgattgcattaaatctgtagatcacgttgaggaatattgacattttaacaatattaattctgctagactttgaacataaattatcccccccttttttgtgtccttgtcaatttatttcatcaggggtttatagttttttttttgcttttttgttttttgttttttgctttttttttgagacagagactcgctttttcacccagactggagtgcagtggcatgatctcagctcactgcaagctccacctcccgggttcacatcattctcctgcctcagcctcccaggtagctgggactacaggcacccgccaccacacctgactaattttttttgtatttttagtagagacaggtttcactgtgttagccaggatgtctcgatctcctgacttcatgatctgcccacctcagcctcccaaagtgctgggattacaggcgtgagccatcaagcccagcccatcaggggtttatattttttattgtagagaaatttcatttctttggttacttttatttctagatatttggtaactattgtaaaatgaactgtttgattttttttcaggtaaatcgaaactgacttatagaaatgctactgatttttgtacattgagtttgtatcctgtaactaaactgaatttgcttatctattctaacagttttttttttaaagtaaagtctatgtttttctaagtgtaagatcatttcttctccaaacaaggacaacttaacttcttcctttcccatgtgcatgtcctttatttattcctttttcctgattgctctagctgactcccagtatatgtaaaacaaaagtgatgaaagtgggcatccctgtcttctcctagatcttagaggaaaggcttccagttcttccccatgtagtatgatgttcgctgtgggtttgtcatgcgtggttggtatggttaggctttgtgtccccacccaaatttcatctagaattgtaattcctaggtgttgagggaagaacctggtgggaggtgattggatcacgggggtggttcccccatgctgttctcatgaaagtgagttctcatgagatctgatgcttttataagtgtttggcaagttcctctgctcactcttctcttgcctgccgccatgtaagatatgcctgcttctccttctaccatgattgtaagtttcctaaggccttcccagccatgccaaactgtgagtcaattaaatctctttcctttataaattacccagtcttggctattttttatagcagtgtgagaatggactaatacaatgctctctattgttttgtgtgaagttctttctatacagagtttgttgagagtttttaattatgaagcaatggggacttttaccaaatgctttttctgcatctattaagatgagtataaggttttttcctttactctttcgatgcagtgtatgatatttactgttttgcttatgttgaaccaaccatgcatccctgagataaatcccacttgatcatggtgtattatctttttgatctgttgttagatttggtttgctagtatattttaaaggatgtttgcatttatggtcatcagggatgttggcctatagtgttttcaatttttgttttatctttgtctgattttggcttgtgggtaatacttgcatgatagaatgaatcaggaagaattccttcctcttgaaattttttaaatagtttgagaagaactgatattagttcttctttaaaggtttagtggaattcagcagcaaagccattcagtgctgggcttttctttgttgagaggctttttattacagatttaatcctactagttactactggtctgtttaagttttctatttcttggtggttcaatattagtaggttatattccaggaatttgcccatttcctctaggttttccaattcatttgtgtatagatattcataagagtctctagtgatcatttgtatctctgtagtattagatctaatgtcttttttgtttctgattttagttgtttggggattatctgtttttttcttaatctagctaatagttaatttcattttcttttcaaaaacccatcttttcattttgtggatcttttttttattttggagactctatttcatttagttcttctccactctttattatttattttcttctgctaatttcaggtttggtttcttcttgcttttctagttccttgatgtgcatagttaagttgtttatttggagtctttctactgttttgatgtaggcatttattgttccaaacttacctcttagtactgcttttgctgcatcccataaattttaatatgttttgtttccatttttcatttgtttcatgaaatttttaaattttctttttaattttttcattgacccagtgttcattcaggagcatgttatgtagtttccatgtattagtacagtttccaatgtacttcttattaccaatttctagttattcccttgtggtcagaaaaagtacttgacataatttctactttttttatttgttgagactagttgtatggctcaacatgtggtctatgctggagaatgtttcatatgctgatgagaatgcgtattctgcagcttttggataaaatgttctgcaaatgtctgttagttctatttggcctacagtgtagtttaagtttttttttttttttaatttgtctaaataatatgtccaatgctgaaagtggggtgttaaagttgccacttttttgtgatctatctctctctttatctctaatgatatttgctttagatacctgggcactttaccgtttggtgcatacatatttctaattgttagaaattgctgaatatattcctttatcattatataatgaccttatttgcatcttttaaaaatgatttttaacttaaagtctactttgtatgatataagcataggtacttctgtatgcttttgttttccatttgcatggattatcttttcccacccttcactttcaggctatgtgtgcctttagagtgaagtgagtttctgtaggcagcatacagttcagtcttgtctttttaaaatttatttaaatagtctaaatctttcaattgagaaatttaaactgtttacattctaggttgttactgatagataagaagatactcctgtcattttgtaaattgttttctgattattttgcatatcttttcttcctttcttctcttattgcttatctttgtggcttggtggcattctgtagtgataacatttgattcctttctctttctcatttgtgcatctgctcttttgtgagttacacacttcagtgtattttcctgatggttaatattatcctgctgcatccaggtataggactcccttaagcatttattttaaggccagtccattttttgacaaatctccattttgtttgtttgggaaagacttattttttttttttttttaaatttctgaagtatagctttgctggaaatagtattcttgactgatagttttgttgtttcagagtttgaacatatcattccattctctcctgacctgtgagtttttggctgagaaatctgctgttagtcttatgggaattccatgtgacttcacactttatctatttttagaagtctttctttgcctttgactttggatggtttgactaaaatgtgccttggggaggatactttttgttgtaggatctataatatttggggatctttgagctttctttatctggatgtcaatattttttgtagaacttgggaagtttttagttattatttaattgaatagattttctatgcctctttttcatcttttctccttctggagctcccaaaaatcatatatttgtttgtttgatgttattccatatgacatgtaggctttcttccttctttcttattcttttttcctattttttgtctgactgtgttatttcaaaagaatatatttatatattcaagttcaggaattctttcttctacttggtttagtatattattaaaggtcttgattttttaaaaaataattcattgaattctctagttccagaatgtgtgtttggttcttttaaatgatatctatatttctgttgagttattcctcagatgatgaattttttttcttatttatttgtattatttatctgtgattttctgtatctcactagtttccttaaggttattattttgagttccttttcaggtgtcctacatattttcttttcttgggacctgttactaaagagctattgtgatcctttggagttgtcttgtttccttgttttttcatgtttcttgtattctaatgttgatgtctgtacatctgatgtagctgtcccttcttctagttttatggagtagtttccatatgaaaagtgttgttcctgtatccattctgttagttgggtagggtgctttggtttcgattctagatgaacatttcagtgtagtctctatatgattacttctgctataatcaatgtcattggtgtctgcaagttactaagtggcttaggctgtgactgcttttggaggctgtaatgagggtttgctggggattggggaatgtagcaggatagtcctcaggcaccaaggtgatgtgaagggggcatcagcactggtgacttcttgccctggatgggccagtctttaggtcctagtggggtccatgggtaccagtggtggcaatggcagatcagtcttcagccacctaagaaggtcacatgagtgccaattgtgtccacagtaggggaggcatcctagtccctaggcctctgaatggggcacatggcattagcagtgttcacagtggggtgaatgggccagttcctagaactctaaatggggtgcgtggatgctagaggtgttcacaatgaggcagatgtgccatttcattggcacatggcatggatagcctggtaccagtggtgtctgcagtggtatgtgtgagtgggtctccaggcctctgggtggggcaaacgagtcctgatggtgtccgtggtgtctcttagacttttaagataagcttgtgggctagtcaacttggagaatggaaatgacaaagtttagtagttttaggactatttcttgcactttgaattatgtaagaaaagggaaatataagcatatttagattactatgtgttcacattgagtataacccatataatgacccagataaacataaactgatatttatatctatctatctatctatctatctatctatctatctattgtgtatatatatataaatttaattcactggtggaatcagtgggaatatctctcagtgtcttgctgatgattttaacctacaatgacatttccccctctggtatgaacatataatattcaggttgggttatgttggtaatctctgtgaatattatagtgttattaattttacacctttatttattatatggcctaatatcatgatacagagaaccactgttgacaaataacccaataccaaatatgaaaaataaaattgatatgcaaaattaccattgctggttccatctaaacaaatttatttcttttgaaattattgttatgagttatataattaataaaaaggtgagttactattttgatttataagcatcctattcttaaagctgattacaataatcatgcagaaatggaaacagatgcttagaatttagcattatttcctaatttactctatgatttattataatctcctaactattccacacagctagtgaataggatgactttctagagaaaatggctttatttaagacctagtattggaaaatatatttatttcaacaacaatggttagacatttacataaaaggcagcttctgggttcttatgtcatttaagagataaagagaactggatagtatttctccctccttcacaataagaaaaaacagttttttaaaacatcttaaaaattgattacttttaccataagacaatgaatgttgtagggcaaaaaaagtaaatccagagtgacaaatgtgctctaaggaaggaacaagatccaggaatttgtttacctgaggcataagatgctgaatgtcatttgagttgatatgcggagtcaattagaagtttttcactaattactaatgtctgagtgtagttaagcatgaaaattggaagccacaacaagacactggcaaatgttaggtttgcaccctcttacaagattttcctctagcaaccacaccaggtactcacagggaatactgttgagaatactgagaaagcctccctcatggtgctggctgggcagtgagtgacactgcccagcccagtgtcagtctcatcttcggcctagtctcatcttctccacctctgctaatgaaaacaagccctcacaggcaaagcagaagtcatcaaaacctgtggcctgagggcacatatggaaatccccagcaactctgggaagaaaacaagaagaaaatattacttcttagggaagtggagaatatttagcccattattttgtctggaggtggggcagggatatctatgaaggctttaacctggtactcatttttgtagtacctgcctaggactacaactcaaagaaaacttcagagaatgactccccctcatttcctcccaaacaaaatactttcaagatacctgtgaaaataacaatgggatatagctggaagagcagcaagagagaaataatcctttcttgtgagcagcacaaagtggagatctaaagtcagtgggggaacaaagtccgtcaggaaacatttatacagaaaaaagcctttggtaaattagtcaatgctatgaacataggttatcactagaggaagttgaaggttttggtgtgctgaggtaacaacaccaacaacaagtgtcgacccatttcaactctcaactagattaagcataaaaaataaggcctagcaacaggtaaggtatattcattttcaagcataaaaaagcataagtccgtagtatctactgtcctatacaacaggactaccttttaaaaacaaagcctgcagagaaaacataatcatcaaaaccagtctcaaatattatacatatgttaagactacaataattaaaaataactataattaatattttaaaggctaatggaaaatgtagaaaatatggaagattagatagaaatttagcagagagattgaaactataagaaaaaaattgaactactagaaattggaaatatcataacagatataaagaagcccatctttgacagtctcggtagtatgggcaaactttggagatattgtaggttcagttccagaccactacaataaagtgaatattgcaataaagttagtaacttttttttgtttcccagtgcatataaatgttatatttacactatactgtagtgtattaattatgcaatagcatatgtctaaaagggacactgtacatactttaatttgaaaatactttattgctaaaaatatactactgatcttttgagtcttaagcaagtcataatctttttgctaatggagggtcttgcctcaatgttgatggctgctgacagaatagggtggtagttactgaaggttggggtggctgtggcaatttgttaaaaaacaagacaacaataaactttgccacattgatttactcttgatttcatgaaagatttctctgtagtgcatgatgctgtttgataacattttacccagaatagaacttctttccaacctggagtcaatcatctcaaatcctgctgctgctttatcaattaagtttatgcaatattctaaattattccttgtcatttcaataatgttcacagcatcttcacagggaaaagatttcatctcaagaaatcactttctttgttcatccagaagaagaaattccttatccgttcaaggtttattatgagatttaatcaattcaatcacatcttcaggctccacttctaattcttgttatcttgctatttccaccacatctgtagttacttcttccactgaagtcttagactctttaacgtcacccatgaaggttggaatcaacttctaaactctggttagcattgatattttgacaaatgttcttaatgacatctaaaatgctgaatcttttctagaagattttcaattgactttgaaagaaatacatttcataaggctaaagccatccattgtgatcagaggaatcacaatggatggctgtagccttatgaaatgtatttcttacataacaggaattgaaagtcaaaattcctcattgatccttgggctgcagagtggatactgtgttaacaggctaaaaaacaaaattaatcttgtacatgtccatcacagctcttgggggactaagtgcgttgtcaatgaacactaatattttgatggaatttttttttctgagcagtaggtttcaacagtgggcttgaaatattaagtaaaacatgctataaatagaagtactgtcatccatgttgttttgttcctttgatagagcacagacagagtagatttagtatctataagggtcctaggattttcagaatagtaaatgagcactggattcaacttaagataagtaggtatgttagttcctatcaagtaactcatcctatccttgaaaggtttaagccaggcattgccatctcttctcgtgttttgaagttttagatggcatccttttctaatacaagggattttgtctacattaaaaatctgttgtttactgtagccaccttcatcagtgatcttagctaaatattctgggtaacttgctgtagattctgcatcagtacttgatgcttcaccttgtcttttcatgttatggaaatggcttctttctttgaatctcacgaataaacctttgctagcttcaaactgttcttctccatcttcctcacctctctcagccttcacagaattgaaaagagttagggtcttcttctggatttggctttggcttaagggaatgttgtggctgtttagatctatccagatgataaaaatattctccatgtcagcaataatgctgctggttttcttattacttatgtgttatttggagcagcactttaattttcgtcaagaacctttcctttgaattcacaatttggctatgtgtttggtgcaaaaggcctagcttttggttgatcttggctttcatcatgcctttcttatttagcttaatcatttctagctttcgatttaaagtgagagacatgtaggtcttccttttaccctcacactcagagaccattatagggttagtaattggcctcatttcaatattgtgtctcaggcaatagggaagcttgaagagaggaagagagacagggaaatggctgcttggtggagtagttagaacacacatttaccagttaagtttaccatctaatatggtttgtagtgccccaaaacaatcacaacagttacatgaaagatcactgatcacaggttgccataacagatataataataatgaaaaggtttgaaatattgcaagaattacaaaaatgtgacacagagatttgaactgagcacatacttttggaaaaatgatgctgatagacttgctcaatagatggttatcacaaatcttctatttgtaaaaaatgaaatattggcaaagtttaagaaagcaaagcctaataaaatgagatattcctgtaaaatcaacccagcctgaggaaaataatcagtggatttctagattggtcaatagagattgccacaaataaaatgtaaagagataaaagagtgggaaaaaagagagcagagtaacaaaaagctatgaggcaatatcatctggtctaacacatgtgtaattagaatatcaaagggagaagaaataatgagcagaagaaattttttaaaaatgtgcctaagaattttctgaaattagtgacagacaccaatccacagatccaaagagctgagagaacaacaagcaggacaaattccaaaaagacacatctacatatatcatattcaaactgttgaaagccaagcaagtgagcaaccaaagtaacacacacacacacacacacacacacacacacacacacacacgagagagagagagagagagagaatcttaaggtagctggtatgggggttatataatttataatagtacttaaaatgaaatgctttggtgtaactaaatataacagaatgtgtggagaatctgtatgctgaaaaggaaataaatctgatggaaaaaataaaagacaatctaaataaatggaaagctacacagggttaagtatttgaaacacttaatatttgagatgtcaattcttaccaaactgatttttatcccaacaaaaatcccaactaacttctgtaaatattgacaagcagattcaaaatgtatacggaaaggcaaaggaaccagattaaccaaacaatttttataaagaaaaaaattgtgagggggatctgacactactacattatagtactgttataaagctacagcattcaagactacaatattaatgaaaggatcaagtcataaatcaatggagcagaataaatatcttagaaatagacccacaaaatgtagccaactgatttttcacaaatatagaaatagaaaaggcatagtctttttagcaaatggtactgaagcaattgaacttccatatgcaaaataaataaatgacacctcggcagacacttcatgcctaatataaaaataaactcacaatggattatagacccaaatagaaacataaactataaaagttctaggagaaggaggattgcatgaccttagcaatgaattcttaggtatagtgcaaaagcatgagccatatgttttataaatacagtttttctatttatgtttgataaatagagtttatcaaaattaaaacattttgctcttcaaaatatattctaatgaaagtgaaaatacaaacaacagactggtagaaaatatttgcaaattacattagagataaagaacttgtatctagaaatgtagagaacatttaacaatcacaagaaaacaaactacctaactaagatgggaaaggtctcaaacattttgagaaagaaaataaacagatgacaatcaaaaccatattgagttacctctacacacatatcagaatggcgaaaacaaaacaaaacaaacatacaaaaattgataatagcaaatgcttgtgaggatgcaggaaacagaaactctccttcattgctgttgggactgcaaaatggtatgtacagccactttggaaactgacagtttcttacgacgttaaatatatattcaccgtgtgaaccaacaataccatgtttggtttttctttttgttttttgttttttgtttttgagacggagtctcacactgttgcccaggctggagtgcagtggtgcgatctcggctcactgcaagctccgcctcccgggttcacgccattctcctgcctcagcctccagagtagctgggactacaggcgcccaccaccacgcccggctacttttttgtatttttagtagagacggggtttcaccgtgttagccaggatggtctcgatctcctgaccttgtgatctgcctgcctcggcctcccaaattgctgggattacaagtgtgagccaccgcgcccggccccattgtttagtttttaacctaggtaaattagtaaaagtctgtgtgcacaaaacctgaaacctgtatgcaaatttttctaaaagctttataatcaccacaaagcaaaaataaccaggattccctttaacatatgagtagattaacatgctgcaaagtacctatacaaagaaacattactcagcactaaaaagaaactgttgattcatacaacaatatgaagaaatcttgatttcattttgccaaatgaaagcagcaagacccaaagggctgtatactgtataatttcatttacatgacattttgctaaatgagaaaaaaaaatcagttgttgatcaggacatttagttttgatcactggagagcacacaatggaaatttagaatgaggcaactgttttatatggttctgcagtgatgtacaaatgacactacgcatttttcaaaatttcagaaaccatacaaaatagtgcattaaatgtactcatattaaaataaaaactaagcttttggaaatccaaggatgaaatgaagactgtgccaaataaatctaagtacagggtttaatctcactgaagtgtgtgagagaaacaagaaagagctcacaataacgttgggaacaatgttttgactagaccataaaattaaaggcagaaagaactttacataagcactttattttagctggtaattttgatctcacagggtaaatttagccattctggaactacaactcctaaagttgtacaagtaagtaaacaaaatgtagacagttcactacatggaatggaatgggaaccaaattctttatatcgaaaaaggaaattacaaatgagcaagtgggagaggctagaatgaccactgtggccatgagttacaattggaaataaaagattgagttcttgtttcttttaatatgcataaatataagtaaatacagaaatacatataaacgtgtgcatatgtacatataactttctctctctttccagaaaaagtaaacaagcaatgatagttctatagcaatgagcaccactgttgtttatatcatggattctaaatatgattctgcaatcatatttagagaaatgactgatttctttggtcatatttggagaaaatatggggcttgggcaggaaaaatacaaatgattctggagcatcctctggtgctagaaagcaagcaagggctgataaatacataaacatacagataaatacatagggcatgtcaaagtgatccaagagttatcctgaaacctcaaaaaatctcccaagacaaccctagaacaacttgagtaacaaaataaacaatgtcattattgaattacatccattagatcaaataaacacgtgcccatactgttataaataatcaaataaattaattgatgaagaaagggaaaagcttctttacaaatggtgaatgtagaagaatggcagaaataacaagtcaacaggtctgaaaatatctccccaaaatatttattaagtactatggtagttgaaacatatgcctgtaaattctctgatactcctctctccatggtggagcttgagggtgggttagatttgttaagaagcttctaatgaatagagcaggaaaagagacaaaaggcagctttccagtggagaaatctatcagtcgctaacttagccatggtgtcaaagtaagccatctccaataacaaatcatgttgatatcaagtttccctgacatattagaaaaaggctttaaatgatattcttcacaaaatccatacctcagttgcactgtgagaaccacagaaacccatatcaagggccattctacaaaataccttccaaagtatattggtaatgaacaacaaggaaaaactgacaaactgtcacaaactggaggaaactaaggggatacgatgacttagtaatgtggtaacctggactggatcctggaaatgaaaaaaaaattaggggaaaatacaggcaaatcctaatgaagtctgtaacttagttaatagtattataccaatggtaattttttacttttaataaatgtatcatggttattcaagatgttaacattaggggaagctagatgaagcatatatgaaaactctacaagctttgcaactcttctttaaggatttaatcattaaaaaattaaaaataaatgaaaaaaacagctgcaacaatggtctatacgttgagaatttcaaaaagatgctgtttactttgggattcaagtaaaaacactatagttgttaaaccctagagtactcttgaaaaagacggttttgtacactttaaactgaaagagtataggaaaaataatttcactcttacagctaggaaacaaaagggaacaaatacaaatgggataattattgaagtttctgcaagggggaataaatcgctcaatgtcccttcattgcataaaggcaaagttctctaattattaaagaaaaaaacctcaacattttgattgataggccctgtgacatctgtcatacatcttgacattgttacctaacttctccctgggactgaataactatcaggtgccgggtaccgctaataaacctcaaacactttgcatgccccagtgcataactgtcgccctcagactcttaattgagaaacattctttcctcctttgtgacatcacatccactaaccaaatggggtggtgtgagtatctcctataaaataaaagctctcctgatggcctgttcctgcacatttcctgaggacgccctcgatcacaagcaggttatagctatttaaaccttgccttacctgtactctttacacaaattgaaggtcaaagaagtagtcatacttctgggcatagattaaactgattttgtaatactgtttaggctgaacctatcagtttcagactaaaccctccaaatatctgcccaaacttgccccataccctctaaaaccaaggcctaacaaagcactaaaatcaatagatgaaaacctaattgagaaatgaatcatgaaactttgtactattccttgtagtacttctctaaatttaaaaaaaagaaaaagaaaaaaaaacacagggcagtgatataaatttgttcagaatctcaggagtataaattgaataatgatctcccacttctctgtagtaacaaattcaaatattattttgtctttggtgcataatgaaattgcatattttacagctgtaaatctgttttctgttcctttagaatctgtttaattcagagtcatatgtttgctttcttctgagaaattcgataacgtacactggtaattatgacttagggcttattgagatattgtcttaatttttaaaagtctttaaccagggcctcaaggaacttacatttccctatattctaccatactttgtggcattctaaagtttagctgagctctaggactgactccatccatctaattacttgttttatctctaatagtctataaactttctgatggggactaaaattttttctcaaagtaaagtgtatcatctgaagcataatatatcccaaggaggtaaatttctcttttctgaaagatcataaccattcagaatttttctagttagtaaccaggagattttagagatgattctttgggtctcattcactatagccaacaatgggtttccaaatgtattcattttctgtggctagatattaaattagcacagagttaggcgcaaaaagcaacacacatttatcacaccacagtttctgtggatgaggagtttgggtaaggcttaactaggtcctttgttcagggtctcacaagccgaaatcaaggcattagccacgttgcagttctcttctggagctcaaagttctcttccaagctcattaatgttggtagaatttagttacttgtggttgtagcatcaaggtcctctccttttagaggctccccctctttactggcagctttcaatacagctgtttctctttaaggctagctagagattcttttgcttttatggctttcacctgattaagtcagtgcccatccagaataatgtcccttttgagtcaaagtcaactaattagagatctcagttacagcggcaaaaccctttcaccttttctgtgttacataatccaatcactcaagtgacatttatcatattcaaagatcctacttatattcaagggagagggttatacaagaacatgcacatctgggcattttaggagtcattttcttattctgtctgccacgttgactttcagaaattgacacaatactgtatcacttaaccaaatctttgttaatcaaatctcttatctgagaatttatgcatatataggcatttcatgctttaaaaattagcccttcaacaacctctcattatgagcctgcgtcatcatgaatcatgttacctattcatacataaaagatctgaacaagtcaaatatctcttccatctcaacaaaccagtatcatgcaactatttttctactaacccaatgtcaaaatcctactttcctaagctgaaagcagaagttgaaacttgatggaggcttctactaacagttttactttctaccttaaacttaatggttccctattttgccagtctttgctgcccattaaaagtatgcaatatttcctaagaaagtaggcttactttctaaaattgaattactttcttctttccatgtttctgttcatcactgtaatactttaaatactattaatcttcttccattagaagagggaagctcatggccccctaaccactgcttcctgaatatctagtaaatttattaaaacacgctaataaattaattaaagcatgcccagaaatccagatttaatcttgatttgtttgtaggtcatatcctaagaatgaaaccagaaaatatcaggcagaaaacactggaacaaattttaactcaccattttgacccctttccagaaatgaaaatattcttagataacataattgtttccattcccatagcttgctggatgaataaaggaaagaaggtttatatacactaataatagaaatgttttgggatggttcatgatttcgaaaagcttcagagaaaataaagatgcttaatgtaagtatctttgcagtaagataatgtaattatcttacattatccataatttagaatggttagcagattaaaagtattttaataactctaatggttcctaagaagttgactattatcaaggtggatatcagttcaaaaagggacatcatcaaagcaaaagaaaatgtcgattgatcattacaccaatgggtagttctcaccaagatctctaacccacaacactcagagactacatctttgaagaagttcaaagagaatattatactatgccagtctttggttctacagtaagaaaactagaataataagcacaatggaattgtcaccagaaagtataaacaagatgagtataaacaaaatttataaacaagatgtaaacaaacacgtttttaaaaacctgtatttatgaaaacagtcaatcaactcaaatgttacatacaatttttcaacaagagaaataaaagctataatatgaaaatcacctctggcccacttagagtggcttctggtggccccaagtgaagtcttcttaaaaaggcatgtgacattacgcacacatgtaggacaaactggcctctgtactcaaccaacatcagtgagaaaatgaatttcatttcctgttgctggactactctttatgcatggtgccaaagaattataatattatctgacaaacccatatgggcattttggccaaaaccagatcattgaatggtccccaacaaccaatttccagatggacgcacaaaagcctactgcctattatccaaaaagtgaacaggaatatgttaccatgttaaactgatatccaccttaaggatagtggctaacaatgtcaactcacatatattttgatccatcagtttcccgtctcagtaaaagattaatatgctttctttgtatgttttacataaattgaatcatttttaaaagctttactaaatatgtaatatatggaaggtgtattattaactgctacaggaaatacctgtgggaataagttgtgtgtgtgtgcacatgtatacacacatacatgtgtggttaaatttcaaaatttcttccaagctataggtaaattttcaaatgacttttattttcgtatgtagttcaaaatgtggaatgataagataaagaaatgatactttaggaagccagacttatcaggtattataacaattaatttaaagttcaaactcaattgaaatcactctattgagtctccaactactaaattagttaatgattctttttaacctttgggatcttggtttgatggaagtgaatataagtatcaaaattccttaaatatttccaatatgaagacaagtttaaatcatatataaaattcaaataaaggtctgtcaccaggaacattaataagcataatgtaactgtcactataaagtcttaataaacaagttgtaaacaaaatacaatttttaaaaactgtgttgatgacaatagcttatcaacttgaatgttacatacactctttcaacaagagaaaaaagctgagcaaactgaaatcaatgaattttattggacccattagagaactgaagtcatagagcaaatcatcatcctgaaatctggagacaggcaaatacagagggtcataactggagtctgcttatttggagcagaagtttccaaagccataaactggtagtaacatttataaggtaattcttctgaactgctgaagctttttgatgaggctgagtttcaatcagcacgagcataagaaactcagaggtaccatttatggaggcttccatactttggtgggtttttacttctaggaaccccaccaacttatcattgtgaagaggtaagagagagaccctcacggctgtgacagtgggtagagaaagttaccatttgaaatatttgaaaccatttttattttatttttataaaataaatatttttatcctaaaaaatatttattctgttagttattttatccccccactatcacattcttgtgataatcacatcttttaaatctgtaagcaatgttatcttttaatataatctttgaaatataatcttcgaaatctcacaaaaatttatattttataattcaccgtgaatagcaaagccaaaagaataacccactatttcctatactcaaacatgttacacatcaacccaaaagaaaaaagacacgaaaccaaaaccaaggaaacacatatgcttagttaggagttaaagttactcaagctctccaaataaaacatacaaattattagcattaattaattattattatttttttgagatgcagtctcactctgttgcctaggctggagtgcagtggtgcgatctcggctcactgcaacctccacttcccgagttcaggtgattctcctggctcagcctccccttgtaactgggattacaggtctgcgccaccacacctggctaatttttgtatttttagtatagacgggatttcaccatgttggccaggctgatctccaactcctgacatcctgatccacccacctcggactcccaaagtgctgggattacagtcatgagccaccgtgcttggcctaatttaatacaattataacttaaatggccactttgtcattgacaatgattgcttgagcacagggtgagtgccccataagctgttaggagctgtttcttcagatcaatgtctcctctctgcactgccagctcctacctgtgcatcatcccctatatactgtgcattatatgtatatatatatatatatatatatatatatatatatacacacacacatatatatctttaaaaaatattttccaccacacatacttcctttcattaatcagataacagggaagaacaacaacaaaatctgaacaagccgatcactttctctttgggatatgatttttttccttgtgcatgaagtattcagcaacaacataagaaagggaaaagaagaaccatttcttgtgtatactccctaaacacacaagcctagtccactgggtgggatataactgtatttatatgcctacctccaggcatggtcacttgatgtttcactactactggttgctgtgtctaagttctcacactctgcttgacaagtgcttctttaaggggataacaggctagaactgcagctctgcaagaagtcattcttcccaaggccacttcttctcagcttctctgtcttcatgaattctttgagctcaatcttctgtgagaagaaggcagttgtcttcattttcaggatagaagacactgttaagagaatgaacagagtagtcacagactgagggaaatatgcaaaaatacaaaagaaattactttattgtaaatcatacctaacactcaacaataatagtacagacaactcaattaaaaaatgagcaaaagatctgacagacatgtcatcaaagaacatgtacagatagcaaataagcataggaaaattttatcaaaacatttgtctttaggaaattgcaaattaagacaaaatgctgctacatacttgttaaagaggttaaaatttaaaaaattggacaataccaatatgtggtaaggatgcagtgcaacaggaactctcattcactgctagttttggaagacagcttgggagtttcttacaaagttagagatagtcttacctcaacatccagaaattatactcttgaatattaatgcaactgacttgaaaacttatgtctacacaaaaacctgcatgtcaatgtatatagcagctttattcataatcatcagaaagtgtaagtcacaagatagccttcagtatgctaatgaataaacaaactacgacatatcaatacaatggatactgtttagtgataaaaagaaatgaaccattaagcaatgaaaagacatggatgaacctgaagtgcataatagtaggtgaaaaaagccagtctgaaaaggctacatggtatatcatttcagttatatgagattttagaaaggcagtaaaaagaccattaaaagactattgtatgttaggagtctggagaagcataattctccacttcttccatgtgggctatgcaagttgacaccctttcaaaggctacagtgtggacaatggaaaaagtaactttacattagagaaatggacaaatctacctaagcccgatgatgaaggccaacattaactgtgacaaggaatgtcgatagcagttgccttgatatgataaaaggcactttccctttgtggccttccaaatatgtataaattattctaaccatcaaacactaattgagggacattcaacaaaataccttcccagtactcctcaagattgtcaaagtcattaaaaacaaggaaagggcaaaactgcaatagccaaagaagctgaaaaagacatgactaattgtgatgtggtgtcctggatgggaccttggaatcacaaacagacattagcaaaaaattaaggaaatctgacaaaaggcatggatttaataacgaggtgttaatattggttctttcattgtgaaacatgtattatataatgtaagatgtttctaataggagaaagtgggtatggagatacatgaaactctgtgctatctttgcattttttttttctgtaaattaaaacggttttaaaaaacaaagtttatattaaaaatatttaaaatgtcatgaccatctgcctcttgtcatatagccatgcctccatggctaagacatataggagtaattaaatggttcttttattaaagaaaggaagaaaggaaatatcttacaatgtgatagaggaagtcactttaaactatgcagttttccctttcagaaccgtccaattcaaatgttctctgacagaatttgtttacattattaattctgagagtcttgataactcttatacttgagccaaaattaaaatgccaggagaagtatccatttcaaagggaaaaggaagtggctacccacgtagtttcgtaaagacttgtgctcctgagaaacaaagaagtgaaccagacagaagataaaatgctagatgaaaattgatgataataattgcttgagaaggcttagaaaaatagaaaatcacagtgggcactttctgttttccttgcttgctgaaagacaaatagaaacaaagtatcaggtacagatgcttctgatatgggatcacacaataacaacactgcttcagacacactctaatgaaagtcagctttctttcaaatcattttaaaaaaaattgtatcctttatttcctattttgtgtaaaaaaaggagtatggatctttatacagatagagtgaagtggagatttgcaaaaccactgaagtattttaaagattgtaaaataatcataataacaattatgtattgaataagaatggtagtcactgccctaaatatttaacctggtttatcgtatttaacttcccaaaccactgtatgaggtagacattactattatcattcccattttacaaaagaaaaaaccgtatcgataacgcttcaaattgatgctcagaccacttccctgccttccggtcataagcacacaagtttacttagcctaaagaaacttctcctagttgtcaatatgattaaattatataaatattatttaattatctcaagttctgaaaataagatatatttaactatgaagatttaataaggcaaaagtataaggacagatgagttatgttttccattaaaatactagtttttaaactcagagtattgacactctaaaacaatgttaaaaacaagctgaccggggaggattgcttgaggctaggagttcgagaccagcttgggcagcataatgagactccatcttaataaatacattaaaaaccattagggagtgtcgtggtgcaagcctataatccctgctactcaggaggctgagccatgatcacaccactgctctccagcctaggtgacagagcaagaccatgtccaaaaaaaaaaaaaaaaatgaaacataacaacaaaacataacactgtttccccagtttcaatttctattatataaaaatcctcatttgcagttttacaatgctatctatatggctaccaccttttcattaaatagttctattgtctttatgaactctctctgacttgcatttggcatatattgagaactcttaaaattcagtaaaatatacaaaaaacaatacaaactaggcaaaatatttcagcagacattccaccgaagaatatacataaatgtcaaatatacttatcaaagatactcagtatcattagtcattagtgaaatgcaaattaaactcaactagataccacaacaaatctcttagagtggctaagaaatactcaaaataccaagtgctagcaagaatgcagacaaactggaacattcaaacacaggtgttaggaaatagtacagcccatttgaactatttgacagttcattatacactcgctatcaaaccagccactctacttttaggtgtttgcccaactaaaaacttatgtttacgcaaaaacctgcatatcaatatttatagtagcttacacctgttggtgcaatagtaattgtgtttttttttaaacagcattactttcaatggtaaaaactgcaattacttttgcaccaaactaatataaaacaatttggggagaactggcacctttactatgttgaatgttctaatctatctgtatttgattttaaaaaatttcccttattaacattttgtagttttcaccacgtcaattctgtacatgttttgttatattactatctaagtagtaaattttctttggaatgattgcaaatggtagttgagttttaatttcaatttctaaatattccttgtttgcatacaaattgtgattaagttttgtctgttgatcttgtaacctgcagccttggtgaactcacttattggttctaggagtattttataatatatttatagggctagtctacacaccacctgttatggcgaggtccctcttgctggttggtgcacagctacctgggtattcctggatgtgggagtggggtttcaggataagcctggtgggagagtgcttctactggcccctctatgtttactgggtcctgattgattcctcttgctggtggaatcttgcttggtattattggagggacatgcatttgatccaagggagacttaatcctttctgagccaccttcttttgctagattatgggctgggaaacacttggcctgtgtggccttcttctgtttggtgggggaatataagacaaactgccattataatttggctttcctccagtcctaggattccaaatcagtttgtcttcctcttccctgcttaaaacgttttccctaagggtatacaaaaaccttcattttctggattttacctgtaagggataattggaaggacagctgagttcaggcaagctgatttattatcagtcctgccgggctacctcctgataaaagcagaggaggcagccctgctttcagaccattgcatggctttacaaggcgaggaacagggtcagggtgggggagctgagatgggtgtgcaggtgtcttgaccgcatcctggagatgttttttgccagctttgttatgcaaggtgaacagacatgtcaaccgcatcctgtaactgactggttagttactggaggggtcagtgaaggggggtttgtctttagccctgggggagctgtgcggatgtcacaaacgactgcattgtaagacccatgggaagggagggggaacagtctggttggggtgaccctaacattacctatctctacaaattccctgtcatgtgcttaaaaaaaaaaaagacaccagccagagttgacaggcaaagacaattgcagagggaggcaagactattgcaataggggagagagactaaatttaactcccctgaaacaaaagatgggacagtttttaatgacaaagtactagagaactttgcagggaggttggtaaacatgattcggccatctgtgtttgctaatacgtgcttatctaagttaagctcctacatttctatagagactggatgaaggcactccatctttcttggtgtatacttttcaaaaggatgactctcaggacctggagaaagacattcctagtctgtaaaacttgcaagagaagatttacatctctaagctgcagcgaaagaatttacaattttaacttttctaaagtaactgctctaagaaaagagagatcaagggcctagagtcaggaagaaacttgtctgaagttgagtcaggttcaggggaacttctaaggctgccttggtcagtgccagatgacttaaaatttccggaatgccatctgctaatttgcactttcttgtttttgcacatgttggtttctctgtaaaatatcctctcctctttgttttcctgacagtttccttattttgtttcaataatctgttcaatctttacctcttctgtgaggtacactcctggttactccatatcagttgataaggcacattttgtaccacctttttgaagcataatgttgactttctttagaaagcatattctgatgctttcaaaaagacccagccacctctttttgatcactttgtaaaacataaaatgtctttttgttacaggacttttcattagttcagctcaagatgaggtccttatcacacagctacgaaaatttaggctagcggacgatttgaggagtgaaaaaaatggaaaaggggggaaacacagactctccacaaaggcagagtccctgctggtgcgcttcccgcctcgcagtttgaatcccaggttccacacaggaagaggaggggctaagctcctccctgctgcaaaacccacaggaacttcctgagtttccaccccagtgcccaaggccagctggagtttttatggggagtccttcccacttgtctgcctcatttttgtataggatttacataatttcattgtttatacatctctccttcactctatctctcacatctctctctcttttttttttttttcagttgagacagactctcactctgttgcccaggctggagtgcagtggcgcgatctcagctcactgcaatctctgtctcctgggttcaagcgattcttctgtctcaccctcccaaggaactgcaattacaggcgcatgctacgacacctggctaatttttgtttgttagtttgtttttgggacagagcctcagtctgtcgcccaggctggagtgcagtggcctgatctctgctcactgcaacctctgcctcccgggttcactccattctcctgcctcagcctcccgagtagctgggactacaggcgcctgccaccatgcccggctcattttttgtatttttagtagagacggggtttcaccatgttagccaggatggtctcgatctcctgacctcaagtaatctgcccacttcggcctcccaaagtgctgggattataggcgtgagccaccgctcccagcctctctcatatatatctatatatgaaactctatccccactcatgatgtaaagcttgaagctaagtaagcactcaaaaatactttaaattgaataattaaagcaattttcacattgtgttaaaattttaataatatgtctcttcattcttgtctctgagtaacttgagttcattcatcttgtgaaaaaggccctagcaccttgtctggcagctgcttactgattatttaatgaacaaatggatgagtaataataatttataaagcaaaattatttttccagaaaagtaacaattttgtatcaaaacttggaatgtcatattaaagtccttaaaaattaaatttacttaagaattaaaagcctcagattttatgtttaaaaggtaactatgtcttttttccttcaactattaattttgtttttcacaaatggccaactcttttttttaaatgactccttttctcctagaatcagaaattgtactttgaaaatatactctagatttaacaattcaaatagcccactaacactgacaattttgatgtaaaagaatgattttcttctgggaaattttatatttatgcatttaaatttctcttgattgtttttccatgtacttcagaaagctgtgaatttttttttcagccttccacttttgtgtgtagttatcaagttttagctcatcaaactgctgaatttaagctttatctgtctaattaatattcttcagcagttcacagtcttcatttctcatttcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaatcatcaccaaaccagactcactgaaatgccaacactggcatgtgcgcagacattttctattctggacttacttctaaacagcaatgccaacaagcatgagaggtgaaaaaatgtggataaatacatgtttggtttattgaactaggtcttatcatatccaaattaaaaacaaaaggcacatctcaatttcaaaataaggttctgaattttaattctcagattcattgaatttctttttgattcaaaattcaaactcttctatcgaatatatcctttagataaattgtctcccaaactcagcagcagattctccctttttcttgtagccacatgaatctatatattttcccgaccagagtctccatatatattgttgatagaaacataactttctattaacaaaaattgtttatgcatatctactaatttcttacattgtatttccaccaaccaaacataaccaagatcacacatatattcaatcttacactgagaataccttaaaagctaatattttaaactttgtaattaattctgtttgtctctattttcatttaaaaaaaatctctctcgttagtacctaccataatttatacccagtctctctctctctgtcacacacacacacacacacaagcacacatacacacagtgagagggagagtgggagagactgttttgaatgttttggttaattaactataatgtatttttctcatttgtattttatttaaattttcatatttactttcattgaaatgaaatatttttccacatttatttttattgaaatgacaatacatgaggccaggcaaggtggctaacacctgtaataccagcactttgggagggcaaggcaggtagatcacttgaggtcaggatttcgagaccagcctgattaacatggtgaaaaccagctctactaaaaatacaaaattagctaggtgtggtggcacatacccgtaatcccagctactcgagaggctgaggcaggagaatcacttgaacctgggaggtggaggttgcagtgagccaagatcatgccattgcattccagcctgggtgacaagaatgaaactctgtctcaaaaaagaagaaaaaaaaaggaatgacaatatatgaagttttcctgaatggggagaaagtataatcagagagtaaagatgtaacaattcttagtttataacttcaaatattaggatctagtggtaagctacctcagtctatttgggctgctataaccaagtctgtatcctcacatggtagcaaggaaggcctcacaagctccctcaggcctcttttacaaagacattaatcccattcatagggccacagcccataggacccaatcactcccaaaggccacacctcttaatattatcacattggggtttaagtttcaacatatgaattttgggggacacatacattcagaccatagcataagccaagtaaggattttgagtgatcttttaggaagtgggactattttttcccatccttcttttcccctttgtccaaactaaatgaaaattttgcagtgaaaaaaggggaaagtctgaggaggaaaccaaagggctagacactaatgagatctgggaaagcagttctttcgtctcaaaattagccacagtatggaacgatgaaaagaaaggatgtcaggaatcaaagaatagataagacttattgtgtgttcatacctgatcatctaggaaacctaaaaatctccccaaatctcctagggccaggaacatggatttggaacgtcctcacagataggtcccatgtgatttggtcagataagaggagcaatctcacatttccttaactggcagagagtggaagttaaggaacagaaagcaaacggctctgaggatgttttgtaattgtgattagaagaatctagagaataaattagattggaccataaagttagtgagcagaatggggtctgggataacaaaaagctctctgcctgaaagtgtggagaataggatcccagcagaggacagagcacatccacagggcaggggctttgctccttcctcactatatatagtggtcatacaacctcttagaaaagaaaattctagagagaagtgaaagagaaacttctcgagctccctaagtgtaaatttgaagtgacaaagaatactgaaataattgagtttaacttgaattgtttatgactatctaacatgaggtggaaaaggagcttttgtgatatgttaaatcatagaaaagtcaagaagttacatgcctaccaagctctatttaaaaaaaaaacttttaggttcaggggtacacgagcatgtttgctatataggtaaacatatgtcacaggagtttgttgtacagaatatttcttcgcccaggtattaagcctagtacccaatagttatttctcctaatcctcttcctcctcctttcctccatcctcaaggagaccccaatgtctattgttccctctttgtgtccatatgttctcatccttaagctccaacttataattgagaacatgcagtatttggttttctgtttctgtgttagtttgctaaggatgatggcctccagctccatccatgttcctgcaaaagacattatctctttcttttttatgcctgcacagtattccatggtgcacatgtacctcattttcttcatccagtttaccattgatggcatttaggttaattctgtgtctctactattgtgaatagcgctgcaatgaacataggtgttcttgtgtctttataggagaatgatttatattcctctggggtatacccagtaatatgattgctaggttgaacggtgcttctgtttttagctctttgaggagttgccacactgctttccacaatagttgaactaatttacattcccaccaacagtgttcccttttctctgcaacatcaccagcatctgttattttttgactttttaataatagccattctgactggtgtgagatggtatctcattgtgtttttgatttgcatttctctaatgatcagtcatattgagctttttttcatatgacaagtctatttttaagtatcattagtgaactaattatgaagtttattaccttatatttctctttgatataccagcattattatgatataatgcatatatcataaagtttgtagtttctcatttgctgataatttcagtatcagaaatctcaaagagttttaattttaatctctattttctccatatttaccattttctttctttgtatttttatttctattttttaatgtataatcttattgttcaaaacacttgggtttttctagtgtcaattgcaatcataatcttaactgatacaaattttaacgctgatattgcagtttaattttctataaccaaaactcttctttttcaattcatcttattattttttcactatgagccacatgtctgttgtgatatttaaaagtaacatatcagagcttcatccccagagattctgactcagatctggggtttcccatcttccgcaggagatgctgatgcacggatggaattgaaaaccgctgttgtagttaacttttcagggtctgtcagtcttttgtctagtgagtctgttcatctgaaatgggaccttcaatttggcccacagctaacttttctgatattataattagatgcaaaaagataggttaaaagagatataaacaattctctagtcccttagaaagctgtgaactaaagcaaaattaatacttttagttcatattatattacctgaatggatagaaagaaaaatggatacacagatgatagatagatacataatcaatagagataaagacatagtacatattattgtaactgtgttcatatattataggcatcaaagctatgaagagcgtgagctgccagtgttataaattttttaccgaaataccctagttttacaattgaggagcccttgtttggaaaaccagttaacttccttagataagatctctctgttgtcagttctcaaataaaataaagttatataacaatagaagggtctacatataatacaggatatgtcattagaaatgcattgaattcttatcaaatttcaaggtaccttcccatgtggaattcagaatttattgttagattaaaatatgtaaataagaaaaacaacataaactcaataagcccatgtatacacaggacacttttgggacactatgaggtttgggaccacagggaaccattctcagagatcttcatcaagttaaaatgttctattttaaagtaaacctactaccccattcatagtgaacgtctagtaagatttttttgcttgtttattttgttttttgttttgcctttttctgctttctgatacagttgaggcttaggtatttaggaagcaatataaaaattatccatatttacgaaataggcaagttaatctggttgacttaatctatttagaagttttgattcaatagattcccagtgctgcagtcctaccatttactctttccttcaaatacttaacacagtatttcacttcattattcattcagcaattattgaaaaggctgtgtgtctctgtaaatagaaagatgtagacttctgagtcagcaatttggggtttgctcctggattacatgaattacttatttatgtgaaggcttagtttcttcatttgaaaaatgggcacttctccaacaagtttgcttacgagaattatgtttgcactggtagaaacataaaaagtatgcctcagatattaactaaatagagtgaccatataatttactgtccaatctggatacttttgagaacaaaaggaggtcaatattaataagtacactgggacaacagttacaaatcacaacagcccagggcaaaattgggattcaggtcaatctaataaataatggcattgtagaccttcaataacagcaattcagtctctttcattgtattcctctgagagtagatagtttaaatccagcaatcaacttgcattgcggaaattctgtctctataatatcaatgtaatttcgacttgaattcccaaataaaagcaaaaagtgaaagaagtttttgagcagttttctttaccatgtagaacaaagaaaagtgcctaattaagattttgaaaggtcaaaagttattattattaatttatcttaatttttactgaacgaaaataaatttgttacttatttgacattttttggaacaacattttacgaagtttactactttagcagaatataccatttcctaaattgacttcctttatgttctattaccactgtaaacttgccccctcactcctcccctgccctggcaactcattataactttaaaaagttattttattttattgataaaacattgcagttaaaaactacctatgtatttgttctaagttgctcccacttgtatttgaatggcaaggataaaataaagcctcctaaacggtactatttttttcattgttattccacattacaactaaaatttaccttctattgaagcataaagttcatgtcatgtcaccaaaaagacatgggcatgatatccttatatatttttttcaattaagctcatatcactaagtgctatcctaggaggaaaaaatgatttggagagtgatctcgttcagtttaaaagagcatttttatgccaatatagaacaatgagaatttatcatctgtgataatattttaaatataatgagttcctcttattccagagaatgtgactttcctgaacaacaggagcaagaatcaatgccagattctcttctctaaaaataatcaatttgttactacaggtaaattaatttcacttttttcacttcttagtacaagggggttttaatttctatcacaataaaacacacattttaaatagatgccgtgctatacacattgacacttacttgttgcattatgtagagaaccagtaaaatctttactcacaatttgccaataatttccatagagctttctttctcaatgaaagaggtcactaattccttcacttcacatcctaaagctagaatgaattgtgtcaagctgttagccgtctaggccaccaaaaagagttacgcaaatgatgatgtattcatttataaacactcctagctattttctcagctatcatcaattttccattctatttttaaaaatcatattactttgatatatttctaaagattcttactgttgaatcctaagttattttactctttttcagttgtcaaagttcaaaaacatctgacttttatattgtgaaaaataaccttttataaacctaaacatctgtagtcagaccaggccatctctcccatttcatcaggtgatttctcaaccagaatttctataccaaaaactacagtattctttaaggttctcaaacagatcatatttcctttcctctgaatgtcttcatacatgctgctacctcatttctttacgtaccctattcgcctggctagttcctaagcatttcaaatttcagagtatttttttgttttctcagaaagcattttctgagcctcggattgaagcagttgctattccttatccaaatcacattttatactttttcatataagaaggatctcagaatagcaattaattagtgcctgccacaccacttgaataaggtattaaaacattatgacaaattgcaatgttaaaagccaggagtgaaagaagcaagtgatacaggttagggcaagtttttcagaaattaatgatatttcattgtttgtagtccaacaaaagtgtgttggcagctgcatggtctcgtgacaataatagatattagagatgatgaaagattttcatgactgcagctgaagaatatggggaaatattccgactagctatatctgaaaagacattggggacaatagattatttgaagggtctctaaatacaaatgaacatttcagcatgtggatatggccacaaggaaaattctaagtggagataacaaataagaaggaagatttaaatattaaaaaaccaagaaatcttggggcggggcaagaagtctactaggtagcatgaattatgtggaagatataaaactacagaatttggggaagttaactaaggatggaacagagagaaatggaatgggaatgtgaaaattctgttcctaagtccagtaatgctaccctaaaccaaaatattagagaagtagatgagcaattgagaagacttgagagtgaagggatgcatggtggatttcttaaggttttatttgtaatatcatttttatgaaggaggaggaaaaacttctgtatatacaaaagtgctctatgtttctctccttttttaaatattcagactttgctcaggtttcataaaataatgttttcataaaatgtacagcaaaacaaagataaacttatactactcagatgaccttgttttaagagatgcttgtgccaaatatgaattacaagatgatcatgagatcatctgaatatcttgactggggctcaggataagaaaacaggggattgttggtgtaatgttttattagggctgccattacaatctccacaaattggtggcttaaaacaacagaatttcattctcccaaaatgttggagttgaagagtccaaaatccaggtgtcggcagggaaaagctccctctgaagagactctggggcagaattcttccttgaatctttgagtttttggtggctcaaggaattccttggcttgtggcagcattactgcagtctttgtctccatcattatatgggtctccacgtggccttctctattatgtgaccatgtcttctcaccttctcctttctgataaaggcacttgtcactagatttagggcacacaataatccaggaagatctcatatcaaggtccttaacttacttatctgcaaagagtctttctgcaaagagtctttcttccaaataagagtacattcacaggttcctggggttaggacatgggacatatctttttgggagccaccatccaatccaccacagatagtagcacttcttttttgatcatagtactcataaagatatactttcttttccatttccttttctaagagcccacatcaaaacactgtctaattcatgaagtactgatgtcggctaagaagagactttaattacctcctccagaaatcatctagaataaggaatagtcaaagttttattattctggttcgaatattctgaaaataggacagaaaaatgaatcatcaaacaactggatattttcccctttaatatttcaagtatagatttcactccaagccagcatttgcaaataaatgccatttttatttttaaacaatttagaaaatattttatcacatacctttgagtgtaaataataaatgggttttggcaattgttcattagaattgagagatgtaaaataatttataatatttcattttgagttacgttcatcaattgttcacatttcctaaaatcaggacctcatggaaaaaataaaatttacctacaaaagcttaaaaggcagatcagatttcacaaggatggattatccaaataaaagacacaatacacctttagatggaaagaaacaaacaagcctgaggctaccaagtttatagttaactggtggaaaaatagccattttctcacatgattatcagaaacacaagactgatcacaagtcagtgttgcaaattttatgaatacaaactttcctttttctccctctcttccttctaccctccctcccttcctctctccttccttcctttcctccctacctccctacctttctccatcctttctttcttccttccccccttctttcccttttattgaggagtcagaaacatatataaagggtagattttatatagttaggggtatatttcaaggcacactgtttttgctattgtttttaatatctcagggtaaagtggttagttttcttccagggctgtgggaagtgaagtaagtgcatgatcacacctcatggtggcaaaacaagatactagttttgctttctcagtacctcctctggtcaaagatttgttcacatcagcttatttagctacttttagacttggtatcattaacatgaaggtttgcttatttagagttatttatgtagatataacatgagatattaatagacaaaaccgcaatgttaacatgatgacaggcatatgatattaaaacttgagggttaacatatgcctatagggtccataaagtccctaatgttataattaaaactacttgtgtgagtcagaattatttttacagcctttatctgcttttttatacagatcagaaaaaagagccacacaaagtatttttctcagatttctttgaagcctctctgactttttttcatactaggatcttctattttgccaacattccttgcctatttaaaagtgatattaattatttagtgacattaattatgtattctagaagcacttaatagacatcacttcacatgtgaagtggggtcttcttgcttaaaacagggcttataagacctatttaagtaatatttgactttatatgtgacattttcagcatggtcatgattatacattccatttatccaagtaaagccaaataaaaaaagacaaatctattgacctatgaaaatgattatgcattcataactagtaaagggaatcagtcaagccttttagcatggtgcataaccattgttttaagtggtgtcatactcaagaacaataaatgtatgccattagttagaaaatcatcattaagtttttatgattaagtttctatgttttaatctgtagaacaaacttttatatggttattatttataaattcagggggtcaattgagataaaattctatttaccatgaatttgatttccatttgtacaaataagcctgttaaattaaggattatagatggtataaaaaagaagaaatttcaaattatttaatttcattctggtccacctaataattcttgttatcttggtcttggggtaaaggtagcagtgtttttaaaaacggacctgcttctggattaaatgaatcatggaaatcctgatgcaatcacctgatgtgtctgataaatgtcaggttattgtggtgatgttgtctaatacagtgaagcctgtctccatgggttggttccctatatcaaatttaaaaatgctgtattaatttgtttttacactgctataaagaagtatgtgagactggctaatttataaagaaacaggtttaattgactcacagcttcacatagctggggaggcctcaagaaacttacaatgatggtggaaggggaagcaaggcatgtctcacatggcagcagggagcagggacagtgccacacttttaaccatcagatctcctgagaactcactcactgtcatgggaacagcatgggagaagttcacccccatgatcaaatcaccaccaggtccctctcctgacaaatgaggattgcaatttgagatgagattggggggacacagagccaaaccatatcactctacccctggcccctcacaaatctcatgtccttcttacattttaaaaccaattataccttcccaatagtccctcaaagtcttaactcattccagcgtaactcaaaagtccaagttcaaatactcacctgtgataaaaaaaagtcccttttgcatatgagcctgcaaagtaaaaaagttagttactttcaagatacaaagggggtagaggaattgggtatatttttccattccaaaagggaaaaattggccaaaacaaagaggctacaggccccacgcaattccaaaacccataagggcagtcattaaatcttaaacctttgaaatgatctcctttgacttcatgtctcacatcaagggcatgctgatgtgaggggtgggatcccatggccttgggaagctccacccttgtggctctgtagggtacagtccccatgacggctttcatgagctggcattgagtgctgcagcttttccaagcgcatggtgaaagctgttgggggatctaccattctggggtctggaggatggtggccctcttcttactgcttcactaggcattgctccagtgggaactctttgtgggggctccaaccccacatttcccctctgcattgccttaatagaggttctccatgcaggcttcactcctgcagcagacttctgcctggacatcgggacatttccatacatcatttgaaatctacgtagaggctcccaaagttcaactcttgtcttctgcacacccacaggcccaataccatgtggaatctgccaaggcttagggcttgtcccctctgaagcaatggtcagagctgtatcttgaccccttttagccacagctggagctggagtggctgggatgcagagcaccatctcctgaggcttcacagagcagttgggccctgagtctggcccacaaaaccatttttccctcctaggcttccaggactgtgatgggaggggctgctgtgaggatctctgaaatgccctggagacattttccccattgccttggctattaacattcagcttctctttgcttatgcaaatttctgcagtgagtggcttgaatttctccccagaaaatgggtttttcttttctaccaaatggtcaggctgcaaattttccaaacttttacactctgcttcccttttaaaaataagttccaatttcagaccatctctttgtgagtgcatgactttacactttcagaaaaagccaggtcacatcttgagtactttgctgcttagaaatttcttctgtcagatactttaaatcatctctctcaagttcaaagttccacagatctctaggccaggagaaaaatgttgccagtcgctttgctaaagtatagcaagagtgacctttgctccagttcccaatcaattcctcacctccacctgaaaccacctcagctgagacttcattgtccataccactattagcatgttgatcaaacgcattcagcaagtattttggaagttccaaactttcccacatcttcctgtctttttctaagccctccaaactcttctaacctctccccattagtcagttccaaagtcactttcacattttcaagtatctttatatcagcacctcacttccagtagcaattctctgtattggtccattttcacactgctataaagaactacctgagactgagtaatttatttttaaaaagaagcttaattgatttatagttccacatagctttggaggcttcaggaaaatgacaactatggtggaaggcaaaggggaagcaagtaacatcttatatagcagcaggaaagagagagagcaagggaggatcatcgctttccatcaaccatcaggtctctgagaatccactatcatgagaacagtatgggggaaatccacccccatgatccaaccacctcccaccaggtccctcccctgacacatggggattacaattcaagatgaggtttgggtggggacacaagagtcaaaccatattaaggaccttctttcgtcctgaattggtttgttattcttttgatatttcttccagaagagtcaacttctgatctttgacttgtagcatgagccttaccacaaatgtacaggaaaaaaaaaaaaggaagtcgttcagtgattataaaacctaatagttttattataataatacacactcattttatgagaaattattcaatggttacattaaaagtaagcatgtcaatttattgtccataattgcccccatctttgtacaagaacacgaaggtgcttttacttatactgaaaggtataccactgaaacactgttatatagtaatgttttattgtctataaataattataaatacaattataaattatatgttgttaaatataaaattataattaacagttataaataatgtggaatcaaaaagtaatagcaaaactttgaaagattttgaaatataaaataccacatagaaatcatgagatacagctaaagttgaacttagaatgaaatgtgtataatggcctacattagaaaaaaaagaaatcacccatctcaagaagtaaacacattcatttcaagaaataaaaactaagaacaaaaatccgagtaggaagaaaggaaagatagtttaaaaaaattaaattgtttttgtaaactaataaaatcagcactctgccatctcactccccaagctgttgatgtcctttcatttctttccatgcatgggtggaatattatatttttctctttgttttattttcatttcatattcaaaacatggttaggaaatgtcagcattctagtctccttatttgtatttttttttaattaaacttttctttagcttcagggatccacatgtaagtttgttgcataggcaaactgtgtgttatgggggtttgatgtactgattattttgtcacccaggtagtacgcatagtaccttataggtagtttttcaatccttatccttctcccaccttccaccctcaagtaagccctcatgtctgttgttctatcctttgtgtccatgtgtactcgatgtttagctcccacttataagtgacaacatgcagtatttggttttctgtttctgtgttagtttgctaaggataatagcctccagctctgcctatgtgttctcaaaggtcataatctcattctttttaatggctgcatagtattccatggtgtatatgtaccacattttctttatctagtctgtcattgatgggtacttgagttgattctttgctattgtgaacagtgctgtgatgaatatacatgtacatgtgtttttatggtggaacaatttatattcctatgagtatatacccaataggattgctggattaagtggtagttttgcaaaactgctttccacaatgccagaattaatttacaatcccattagacctgtataagcattcccttttcttcacaaccttgccagcatctgttattattattattttactttttaataatacccatactgaacatagtatctcattgtggttttgatttgcatttatctaattagtattgttgaactgtttcatatgcttgtttatccacatgtatgttttcttttgaaagggtgtctgcttatgtcatttgaacacttttaaatgggttgtttgtttttacttgctaatctgcttaatttccatatagattctggatattagacctttgtcagatgcatagtttgcaaatattttctccccttctgtaggttgtcttaaaaatttactttgttgatagtttcttgtgctgtgcagaagtcttttgtttacataggtcccaattgtcaatttttgttgcaattgcttttggcatcttcatcatgaagtctttgtccattcttatgtctagaattgtgttttctaggttatcttccagggtttttacagttttaggttttacatttaagtaattagtttatctcgagttgatttttgtatatggtgtaaggaaggggaccagtttcaatattatgcatgtgactagccagaattccagcaccatttattgaatagggagtcatttacccattgcttgtttttgccagctttgttgaagatcagatggttctacatgtgtggctttatttctgagtgctctgttccatttctttaatctatgtgtctgtttttgcaccagtaccatgccattttggttactgtagtcttgtagtatatttggaagtcaggtaatatgatgcctcagctttgttctttttgcttagaattgccttgactatttgagccttttttgattccatatgaatttttcaaaactttttttctaattatgtaaagaatgtcattggtagtttgattggaatagcactgaatctgaacattgctttgggtagtatgaccattttaagaatatcgattctttctctccatgagcacagaaagtttttccatctgtttgtgtcatttttgacttctttcagcagtgttatgtaattctcatggacaaaatcttttacctccctcattagctgtattactaggtattttatactttatacttttttggctattatgaatgggattatgttcttgatttggctctcagctaggacattgttgttgtatagaaatgctatagatttttgtactctgttttgtatcctgaaactttgcttaagtactgtattagatctaggagctttggggcagagactatgaggctttgtagttatagaattatattgtctgtaaagtgagataatttcacttcctttttcctatttagatgccctttatttctttcacttgcctgattgctctagctaggacttccagtaccttgttgaatgaaattggtgagagagggtatccttgtctttttctcattttcaagggggatgcttccaggtttttcccattcactgtgatattggctatgggattttaaagatggcttttagtattttattgaggatttttgcatctatgttcatcaaggatattggcctgaagttttctttttttgtggtatatcttccaggttttggtatcaggaagatgctggcctcatagaatgagttagggtggagtctctcctcaagtttttggaatagtttcattagaaatggtaccagctcttcattacacatctggtagaatttgtctgtaattctttctggtcctgagctttttctggttggtaggctttttattactgattcaattttggaactcattattggtctgttcagggattccatttcttcctggttcagtcttgtgacattgaatgttttcagcagtttatccatttcttctaggttttctagcttgtgttcatagagatgtttttaatagtctctgagggtttttttgtatttctatggggccaatggtaatttccttttcatcatttctcattgggcttatttggatctctctctctctctcttttattagtctatctagcagtctattaatcatatttattttttcaaaaagccaactcctgctggatttgttgatctttttatggtttcatgaatgtgtcagtttcactcagttcagctctgatttttattatttcttgtcttctgctagctttggggttggtttgctattattttcctagttcctctagataacatgttggttgtcaatttgagatctaacttttaggtgtgggcatctagcactaaaaacttttcccttaacactgctttagctgtgtccagagattctggtatgttgtatcatagttttcattagtttcaagtaatttcttaagttctgccttaatttcattgtttacccaaaagccattcagaaacaggttgtttaaatccctcgtaattgtatggttttgagcaatcttcttactattgatttctatttttattgtgttgtgataggagagtatagttggtatgatttagttgtttaattttctgagaattattttatggctgattgtatggtcaatattagagtgtgtgccatgtgcagataagaataatgtacactgtgttgtacttgggtagagagttctctagatgtctgttaggtccatttggtcatgtgccaagatcatgtcctgaataactttgttagttttctgcctctatggtctgtctaatactgtcaattggaggtgaagtttcccactgttattgtgtagttgtctaagtctcttcatatttttgtctgacagagctaatttggagaactagtctttgaactctgggattctttcctcagtttatctatcttgctattaatacatatgaccatattatgacattctttaagtgagtgttccaggtgtatcagatcagtttagttatatcttaagatggacatttcatcttttacctcctgtatagtttgtttgtattccttagattccttgtcttgggcttgcactttcctaaatcttgatgatccatctaccttctgaattctgtatctgtcatttcagccatttcagcttggttaagaaccattgctgggaaactactgcaatcatctgaaggtaagaagacaatctggctttttgagttgacagagttctcatgctggttctttcttatctgtctgggctgatgatcctcccatctttgaagttgctggcctttggatggggtattttgcttttatcttctttgttgctcttgggagtctgattgtggcagaaggtgggttcagtccactgacttcacttccggaggattttaggagtccaaagctcagctcggcactcctgggatgagtgctctaactctgatcagctggtactgagccccccagcttgttttttggccccttgaggttatgaacctggtgcactggaagggctgaggttttcctggtacactagccacaacactccaatttccaggggctgccaaccaaagtgctttgttgggacagaggcagtgggatctgtgcttgctcacatgtgccagcagctgcagcagcatggtggggtgcatgcatgttggctgggcaagggcatctagagggggtagggttgtcagcctctctgctagcacttgtgctgatagtggcagtggtgatgggggcactggcagagctgaggttgttggcacctgtgcacaagtttgtaccagcagtggtgatggcactgtgggggtgagtttcctggcatctgtgtatgagttcacatcggcggtggcaaagcagcatcacaaggaaggggtggctgggtgagcttgtgctggcaaagtggtaagggggccgtgagtgagtgcatgctggaaaagctgcacggggagtcttcagcgaggggaaactgggtgggctggtgtgcattggtaaggattagtctgctggagctttccaacagtcaggcatggtcttctggcaaaggagctataacgtgagcccccaggaactgccctggttgggtaaccgaggctgcactgcaagtggatgtggtcaggctggggccccaggagatgccagtagatggaggggcactcagtcatgccctcatcccatgggcgtgactgctctgctctgtccaggtcctacagtcaccctgaggctaaagtctcctagagttcctagaggagcatggcaagctttgagggatgagcatcactggccatgctccgctgaagccattcccatgccaaatcttctgaactacacaggctagagccctgccgtgtcatttctctaagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccagcatttgtgtcttccctgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattattcttgcacctcctgtaaaaatgcatccatccgcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattctgtgaccatagcctttaataagtaacaaataagcaaacaaataaaataagtaaaagtattgattttaccaggattctcttttcaaacctcttcttttctttacatatccctccattgatttccccactccatgcccatgatttaaatatcatttatatgttcatgtctctcaatcccattctttataggtaagcaccagaatagaatgtttcacaacttagtggaagtctccagtatgataaacccataggacttccaactaaagcattcaacactaatcttttcatctccctggcaaggttcccttcagacctggaatcctatatattgttagtggcataactaacaacctggtctcccagtataagcctaggaacttttgaattctctgacttctctactggacataagtaaattcatttttaccctatattgactatcctttctcttttccattctcctaactattgctatatgtaacttctaatgtgaatttctgaaaaaacttccacacacattgcttacaagtaatgatttaaagtgtataacttaaaagactataaacatagatttcataagctataaaaagtccttctagaattataaatcatacacacatgcatgtgtatatatacatacttgatgtggtttatctctgttcccacccaaatctgatgctgaattgcaatcttcagtgttgaaggaagggcctggtgggaagtgagtaattacatcatgggggcagacgtcccccttctgttcatgtgatagagttctcacgagatctgattgttggaaagtgtgtggcactttccccttctctctttctctctttgtctctctctcctgctcccccatggtaaaacatgcttgcttcccctttgccttccaccatgattgtaagtaagtttcctgaggcctcccagccatgcttcctctatagcctgaagaactgtgagttgattaaactacttttcttcataatttacacagtctcaggtagttctttatagtagtgtgaaaatggagtaatacaatactccacacacaaacatatgtacctgtggtggtaaatgctttatagatttctttagagttttgaaaaatacctgatacccaaaatgtttctatccactggccaatgtctccactcaagtcattttgtatgaacacgtgggctgacctgactcccatctatttcatagacagtatctcctaccattccttgcttcaaaacatatgccagttctaaatagcgttgattattattctttaaaggtacttattattacttcacacttctttccatttgagcattttgttatctctcccttagaaataaacttctctgattatttaactaggaaattcctatgtatctttcaaaacaaagaataaatatgttctttcttaggaagccttttgtataatggtttatttgtttgaaatgatgtttcacaacttgaggtgagttgtacattattcctatttaggtatgaaattgtatttgcagttatgtttcaaatctatcttcaatagtatgtgttaatgtcatttactttatatatcaagaatgcaggataatgcctggcacacagtaagctttgaatgagcagagaaaatggatgattagctgaggggttctgaaacagacagtatcatattgttgagtggccctgcgctctcaaccatcagcagtggtttcagtggtgttcatgccttttgagtagccttttccctgcttatagaatcccagaagtctgacagtctttcttcatttcatcccatatttgccccctttatttcaaggggattggggagatgttggttaaaggatgcaaaatttcagatagataagagcaattagttcaagaaatctattgtgcatcacggtgactataattaataacaatatattgtatacttgaaaattcccaagagagtagattttaagtgtttttaccacacaaatatgataagtatgtgaggtaatgcatatgctaattagcttgatttagccattccatgatatatacatgtatcaaaacatcatattgtataacaaaaatatatgcattttaatgtattaattaaaaagaaaacaaccttattgactttttttttggaatgtcaagggaatcaacatttgacatgagggctctccgcggattcttcctggataactttatctctattcctagctgctgcgatgatggctgttatgatccacaagtcacacatgtctctcccctcatgaaggtcaaaatttagtattacagtgcaataaccacacacacacacacacacacacacacacaccttaattacagcagtttaaaatgggtgactgagatcttcccaaaagtaaagggaatatcagtgcatactaacacatgagaatatgtttgaaacagcactgttagtcaggaccagaagatttcagatatccagttaatatattttttaaagaacacctttagaattatattacaaccagatcttccacaggaatagtctaaatgggcgatggaaactaacttcactcagagattcagaaaatttgagagagaaaaaaagtgggagatgagatgaaaatgatgagaatatgtaaactgagtatccgtacatgtgtttctggtattctgtcgttcacctctagtgtgaatgggaaataaaagcttcagattagaactaaggagcagtgtgcaaagactgtctgcagatggagtcaggacaactaccctgggcatagtacccgggggcaaaatattaatataatcttaatataatctgagtgacaagccaaacattttctggttctgttaaacatatgattcaaaaacttcacttgaatgctattttagagagggaaaactagtttcagtgctaaatttgtaacagtaattgaaaataactgaacaattttatcattaagaatgctaggctgggcgcgatggctcacgcctgtaatcctagcactttgggaggccaaggcaggtggatcacaaggtcaggagatcgagaccatcctggctaacacgatgaaaccccgtctctattaaaaatacaaaaaattagccgggcgtggtggccggtgcctgtagtcccagctacttgggaggctgaggcaggagaatggcatgaacccaggaggcggagcttgcagtgagctgagattgagccactgcactctagcctgggcaacagagcaagactctgtctaaaaacaaaaaaaaagaatgctaattatgttaattgatatcttagtgaatagatgtttactcttacttatttttcaataaattattctttactaaagtatactattttctttaatactcactgggttcattgaacaaaagggcctggaataaaataagcaaaaatagcagatatttgttcaattttcacatcctacagatttcaaaagattttctaacaacacacagcatgaaactcacataatatgaagacacaaaactggcccagatatacagcattcaaaggagaatactttagacctatcccctactacattattgttttggaagattacttagaatatattttaaaacccacaatacaaacatttattttaataaagtttatctgcaggaaaaattggtacattatgacccatgcttttttttattattatttttttctgagatggggtcttgctctgttgcccaggctggagtgccatgatgccatctcggctgactgcaacctccactcccaagttcaagctattctcctccctcagcctcctgagtagctgggactataggcatgcaccaccatgcccagctaattttattgtatttttagtagagatggggtttcaccacggttttcaggccagacttgaacttctgacctccaatgatcctcctgcctcggcctcccaaagtgttgggattacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcatattagatcttgccattccctaaattcttataatcagtccctttgcctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaatatttctccaatctttcaatagtctattccagcaaatgaccaccgaatctgtttaattatccataagccagaaacatgggcttatacatatttacaattccttttgccttcatattgaaacggttattgaaattgtaaggattcatgttccctttattttatcaagcttgttctgcctttcatttaacacctgagtcactgcattagccttttttacacacatctctgttccaggcttagtatccccaatctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttaaatgctctatttctagtatattctgaaattttcctcttatttgaaaacttttaaagtaaaaataagtcatttttataatcacttaatatatgacagtagagatgcattttctatttcattcatgtatgttttagatttatatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcgtatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaacaattgttctgctttatcgagatgtttaagcattcttaaattattaggggcaataaagacaagcaaacataaagctaaacagaaaaataaatactcaaaatttcagctgtataagatctcaaaatttgttatgcattgtaaactgtcctatttgtaattacacttaagatcccagatcaattttattctgcatgtactttttgaaaaaagatcaaatatgtatattaagtacaaagttgcaaaagctaaaggttaaacttagttcattataagcctttactaaccctttattttctacctttccatatacaatttccttggaaattaccaaaaggaggaagctttgacttcaggaattgtttattctaccataatctttattggtttccttgcttcaattttcaaatctgcaattgaaattagatatgattgcctagctgaacttcagtaagatgcattttgattatgataccctctacttagaaacattatgttctttcctattgtgctcaggacagactatatgttttagacgaggtcttaagacacataataatctagcctcatgctatatggccagttatctctaaaatagctttaccattctcttcattatccctttggtacttgaagtcatatctcttactgagacgctttcttccatctcctcctcatcgatatttggtatctcattccttaaaatgtgttccgtctgtcaacttaagcacatacctttcccattccatgaaattctttgcagctacagtgattgttccttcctcaacatctatacaaattccattcaataatcaatttaatttctttaatgtatatatacttgtgtttcagtttaattttttagtaaatattcattcaaaatttctagagataattttattcattgcagctgtggcatataagccctaactatgaaaaatgtccatatctatatcttcaaattcctgttttaaaaaaaggtgtgtgtgtgtgtgtgtctgtgtgtgtgtgtttgtgagagagagagaaaaaaaagagagagaataatgaataagagctatagaatcactccctttataccatggctttgtgctcagtatagtcagtgctttgcatataatcattgtggtggtaatattagtagtttggcaacagaaaacacttgttttttctggccattgtactaagcatgcttcatgtgttaactctgaattctcctaccgtctctgtaaacacagatggaaaccctgctgcatacaggtcctaggtaattagcctaggatatcaggctgtagattacatacttatcacactatgcactctccataaatagatgattttattaattacttagttaagcttctataagcaaattttccaggaaataaaccatatgattcctaaaagtcatgttccatacatgtaacatgatgctttgtaaatcagcatagtcaaatatgaaagactgatccacttttcagtgttggctgaagttatttttacctttctttgcgtgcatccaaacatgcaaataatacttaagccattttcttttataaatcaataacaatgaaacacacaggcaacaattgcttcatatatgacagctaaattagcacctgattaattgcatttatgcgataggaaaaccatggaccctctcaacatctggacaaacagttcaatgaaagaactttcctcagttcagttctgtgtattcttttgtgttatgaataccttcaaaatataggttaatcaacatttattgagtactcactctgtaatgagcttaatgctaaggattatattattgcaaatgatattgttttatttcactgcctcctgttactcttatctgggtaccttagattttatctcttcacccactgacctgtacccagttggataaaatatcccccaaattttaatggccaaattgattcctccttctgctttaagatatggtgttcctctgccctaaaacttaccatttcagggacaaactgtttataacttagttgttgcaccagtttctgtgtatctaggagtaagaaataaagaaatcctagtaagttcctactctgggtctgctctctgctttatctaaactaaaactcagagaaaagaaaatacctacactgaagattcaagcagccaattaatatttttaatagatagagggctgtttgggtacccacaacacttattttcttacactccttatgagttatttttggaatttttcagtctgtgtattataattaatatgaatctatctttctaaaaatataattagatcagaatgaatttaaattgacctgaatttaaattgacaaggtttaaaatgtgcgatatttgtttctgtataatattttgaaaaggcatttggtgatgatgcctggatctgattttatgagcttttgatcttacaagattcactgctcatggatcacagctttgccagtattctgagtatttggagattttctagtcatctttctgttatagtttaattgtattgtagtctgagaaaatattttgtatgatttagattcttttaaatttgttaagctagatccaggatgtgatctaccttagtaaatattctatataagcttaaatatgtgttttgctgtttttaaatagagtgttctataaacgtcaatttgataaaatggatcaatactgctcttcatttcaaccatatccttgttgattttttgcctgctccatgtcaattactgatgggggggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatcttcacatttaaaatgaatttcttgcagacagcatatagctggggcttgtaatttatctaggctaataattattgctattttaccgatgtcattagacatatttaaagtgattactcatatatttatgttaaaatgcaatatatttgtaacttttctttcattacgtttgttctttgttactagtctctacctcttgttctactttttttgttttaattattttatattattccattttatttggcacagtagttacacttcatttttacatatctgtaggtgaactaggttttataatatgcattgttaaataaagttagttcagcttcaaataacactatattttatttgtagcataggtaccttgtaacacagtgttccacattctcccttctgtcgcttctgatgttgctgtcatcattattttacttacttatattcttgaattacctaaatgtattattagtattgctttagataactaactgttagatcagttaaatacaagacaaataaaatatttcactttattccttttctgatgcccttttaaaaatgtagattcaagattctgacttatatcatttttcttcttccggaaaaactttttttaacatttcctgtatgacagttctgctgtcaatgtcattagttttggtttgagaatattacttctcctttatttttgaagaatgatttttgtggatgtagaattctaggttggcagggattttttttctccctcaatacattagagatttgataatcttcttgttttcattattttaggggcgaagtcagctataattctaaacttaattcttctgtaagtaaggtgccccttaccagcttccttcaagacctttttttttgtttgttttactgcaattgaaataaaatattcctactgtggtttgtgtgtatgagaaagactgtgtgtgtgtgtgtgtgtgtgtgtgtttgtgtgtttgtgtgtgtctgaatgaaatatttaccctgcttggtgttttctgagtttcttggtttgtggattagtggctgttattaattttgtaaagttcatggccattttagttctcatttactttttttctctagtgttttcttataaatttttaatatttctccacagttcctgaatattttgtttttaaaatcttttttcttctctttgtacttcaattggtaaatttctatcttcaagattgccgctagcttcgtttattattttcttaatagtgttgagtctactgataagttcattaaacacattcatttctgttactttaagaaagttttctgcattttattttttactttttcttaatgtagccatgtcaatgtgtcctgaagtagttggtgtaagattcagtttatacatttcttatgagattttatagaattcagtgtgaaaactacctggggctgcgttttctttgtaacaatgatttttacaatgaatccaataaaagactactcacattttctgtttattcttttgtgagtttgatgatgtgtttttaaaaataaacttatcatttcacctaagtattcataaaggtgttatgaagttgtttataatattttcttattaacattcaagtgtctatgtgatttatagtgataatctttctatccttgatattgataattttttgctcacttagtgttttctcgaataatatacctaggctactatcaattttcctggtgttggaaataataaactttggtctgttaatttttttcatcactttttagtatgaaatatttactaattttctttgtgattcttcctatcattatggattatttagaagttgtttaatctccaaattttaagtatcatatcttattattacttatgacaaatttaattattatcaaagtatattcactgtataatttcagttttttaaaaagtatttagatttgtttgattttttatgtggactttgtgtatgtatcatctgcagggagttttctgtattttttaggtatattgttctacaattctcaattaaatcattctggatgagaagggacctaagaatatttacatctttagtagttttttctctaattgctctatcaaatgctttgtgagacatgctaaaatttccacgcttgctgttttggacgcctctttgattctatcactatctttctcgtgcattttgaagctctgttattaagtgtaaacatatttgttaaacaaggtttacaggagggcattgttttgcactaacttcctgaactaggtctcatcaaaccaggccaaaccaaaatggtgtaacttatactatgtgcaaggaagtaggtagatccccaaatagaccagttttccctgaagacaggagattcatagcaaccaatcaaaaagagcccagtctacctgagtcagtgtgataagaactgtctcctttgcttcaaccttacaagaaaagtgacctgtagtaactttacgttaactgatctgctttctaaaattgttctgccttcttgctcctcccttacaaaaaccaaccattctggcatggcctgtggaatattcattctattttataaaatgaggtgtttcctgattccagaattaaaaataaaaaataattatatctttatgttaaatttgttgtaatattgtcttttgacacatttatgatggttattttttataaacttctcattatattgctagaaaatatccctttttacatacagtaatacattttactctgaagctcatcttatttgatattatgatatatttatctataatagatattattcattatatagttgatatattattgataatattaaatatgagagttctcttatatttcacctttagacagtgaaactttatgctgcaggtttagttaatgactcattataaggaagtaagaagtaagtctaaaattataatgacccacatagttacaatgactatcttgtgattctaatgcttttagtaatcatttcgtgctcattagtacaaatgagaaagattccataccaagctaaaaatttaaaaactaagttttagtttaaaagaaatatttaaaaatcatttctcgttattactacattagatacattccaaatttaaaacaaacatacctaagaaaaaaagatctaaaccatttcataataagaaataaaacaagaattagaaaaacattttttatcactggctttcagataagttatatgctaacagcaattctttcttgttttaattatcatgatgaatttgggattactgtattaccatacagcctatccagtcagagcacacactttgcttaaaccttaccaactccataaagatttcactggcttcttcatctttccttcagacactttctgtctttaagaattatggtgaccttctccaattaagaattatatagtgttctgtattttttctttctattaattattatattttaagtggtgccatttttatagaaacattcatagcaagtagtatgtatgttgtaatagaaagacaaggaaagaaaataaaaataataatttgatatgtaaacttttaaagtaaatactgattaacttcatatgtaaaatttgcataaacttttaaagtaaatactgattattaacttcatatgtaaagtttgcatctgaaattatcaattcatgttttctatagctatcatgttaaaaagatttacagttagaggcctggtgcagtggctcatgcctgtaatcccagtactttgggaggccggggcgggcagatcatgaggtcaggaaatcaagaccatcctggctaacacggtgaaaccccgtctctactaaaaatacaaaaaaattagctgggcgtggtggggggcgcctgtagtcccagctactcgggaggctgaggcaggagaatggcgtgaacccgggaagcagagcttgcagtgagccgagatcgcgccactgcactccagcctgggcgacagagcgagactccgtcacaaaaaaaaaaaaaaaaagatttacagagtaggagtactttcaagacattgtgcatcagagtgactgtaactgatgacaatatattgtattcttggaaaatgctagagtggattttaagtgttttcaccacaaaaatgataactgtgttaggttatacatttgttaaatagctagatttaaccatcccacaacgtatatgtacttcaaaacatcatgctgtacacagtaaatacatacagttttatatgtcaatgaaaaaaataaatttgaaagaaaaaaaaactttgaattacttgattcaacatttgtttgtattaattaatcatgatttcctagtatagtgaagagcaatttagtgttgataattgagtcaagcacgaattatcaataaaataacatgaaaaattattagaatgctctaccaatgcaaaaatgaagctgttaccacccaaatccactgaaaaactttagcatctcagaaaataagacaattagtgttttgtgcttcctgatgaaattcagtatgaagtacatgggacaatctatgaggtagtctcattaaaatacttggcctgaatctaatcaaaattctaagattaacttccatgtacatgggaaaacacataataaggaaaaaaaatataaatgcaactaaaaaatagacagacacattaggatatggtacattcaaatggatggctaacagggtgagggggacaaatctggactgtaagaaagttaagagacacatcaaatataaatgcaataggtggtctttatggatcctgattcacataaacacacggtgtaatttttatgatatcagacaaatttgattattgattatgtgtaaatttatataaaggaaacacttgataatttttcttgaaaaatactggctttaccattaagtaagactgtgtcctctgttcagagattcagtggtaaaatgacatgtggaatttgctttaaaggccttagcaaaaaaaagaatgaagggatgcatataaaccacatatagcaaaatcctgataagttgggaaataaagagattcactgtactttcctcactactttaaatatatattttaagttttattaaaattttgtatagtataatattttcactgacagaaacagaatgaaaaacttgaaggacaaatagtaaaggtttttttattttttttctgagatggaatcttgctctgtcacccaggctggagtgcagtggcacgatctcggctcactgcaacctctgcctcctgggttcaagcgattctcctgcctcagccttcgagtagctgggattacaggtgcccaccactgtgcccagctaagttttgcatttttagtagagacggggtttccaggctggtctcgaactcctgacctcgtgatctgcctgcctcaacctcccaaagtgctgggattacaggcatgagccactgtgcctggcctagcaaatgttaatttaaacatagtttgatcttatttatacttcctcttaagctatcttttgtgactcaattaatgggtcatttgttgattaaatacagtattatctaggataataaaattttttttctataaattatgtatggtttgaaggcccaacccccagtacttgagaatgtgactgcatttggagatagcttctataaagaggtgattaagattaactgaagtaattagggtgggctcgaatccaatttgaccagtgtccttataagaagagaaaattagtacacacaagaggcatcaaagattgtatgtacagaaaaaaaaaccatgtaaggccccagtcagaagacagccatctacaagccaagtgggaaggtttcaagagaaaccaaacctgccaacactttgatctcagacttctagataccataacagaaaataaattgtttaggccactcagtctgtgatactatacttttgttttggcagccctactaaactaatacagcattgcagagaatgcagaagtgtaaagataagaaaccccaaaataattaagaaaatatgaaacatgaaggaaattagtacagattcttaggagaccataatctatctattttactaaaaatattttactatgtaactaatattttttggactagatcttacattctcaaggacaaattttaaatgcattaatacagtattgcaccttgttaaaactgagttaatggaatgcagtggccggataaattaagaaatttaattaaaaattaaatataaacttgagtaaaactcttaacatagaaagttgaatttaaccacaagattatgggtaccttattttttaaaagatgatttatgaaatctttcttgtgtttgcaaaattctttatgtatatgttcataagtgtttggccaggtgagtaggcaaaaaaaataaaaaataaaaaacacagaaaatcaatgaacaggagatggtggtttatggaagtcaaagagaactggattctagagccagctccagcaattattagttactgactcacactaccaaaatctttagttatcatttcacagagaaaaagaggactatttatatattagtctttttagtgttgctataacagaatacttgaggctggataatttataaagaaaagaggtttatttggcttatgattttaggtcttgtgagggactccctcatgctgcttcctccgtggcagaaagcagaagggtgcaaaaagatcagagggtaagggaggaagcaagagagagagaaaccaaggaagccagaccctttttgaacaaccagctctcatgagaaataacccattctcttaacagtgagaactcactcccccaaataaatgcattaatgtattcataagaggtctacccccatgatctgaacatcacataccaggcctcacttccaatactactacatcagggatcaaattttaacatgagttttcatggggagaaaccacatcaagctctatctatcatctatctatctatctatctatctatctatctatctatcatctatcatctatttacttacctatgtacttatatatgattataagaaacatgaggttaattataagaaattggctcatgtgattatggagccttgaaatacgaagatagaggcagcagcagatttgatgtctgatgagagccctcttttgctcttaaaaaaatggtttgcctaccactgccttctttctgtgtctgtatttcagaggaggagagacgtggtgtcctcatcctcttataaaggcatgaatctcatcatgggggccttgctctcatgatctcatttaaacctaattaacatccacaggctccacttccaaataacattatgctgaagattagggcttcaacatgtgaattagtgggtacacaatttggtccacagcattgggccctggtacaacaaattcatgtctttctcaaaagcaaaatacagtcatcccttgatatccaaggaggattggtcccaggacctctcgcagataccaaaacccagatgttcaagtttctaaaatggtgtaatatttgcatataacttgtgcatgtcctttcatatactttaaatcatctctagattacttataatacctaacacaatgtaagtgctgtgtaaatatttgctatactctattgtttagggggtaaatgacaagaaaactgaatctgcacatgttcagtacagatgcaattttttttcaaatgtgtttgattcacagttggttgaatctatggatgtggaacccacagatacagaaggctgactatatattcattccattttaacagccgcatgagccttaattcatttcagcatcaactctgaagtctaaaattcaaagcttcttctaagcatttttaaaatcagatatgggtgagactccaagcaaaaatccatgctgaaactaaatatccctccagctatgaaactgtgaaactagataaggtatgcaatttcaaaatacagatatgggacaggagtaggatagacatcctattccaaaggtaaaaatctgaagaaagaaatggataatttatctcaaggtagtccaaaacctagcaaggcaaatatcattaaatattaacatgttaatcctgtctggtttgatgctctgcctttcagaaccactggggcagcacttctgcctccatggctctgctggtcatgggccgtacccccaaggatttgtggggcctggtagctggcctgggttagtcaagatcatgtccctcactctttgagaccaaagaggcatccccaatgatctctgaattgcctttgggataattcttccattctcttgaagaatagcatatatttgtagcagaatggcaaaataattcagtcctaaaaatagaaatccaagagctttccttcatttcatcccatcactttccctttcagttcaaactggtagtgtgcctgctcatataatcctgtgtgtacgttttcctgcatatatcgcccatctaagcactttgtgtacatacttgtatagaaaatttaattgtgctagctttcatttgtatgagtttgctagtgcctcccttattaaaacttattgcagcttcacctctttctaagataattcaatagaaagccatggaacttctaacatttttgagtttgttttaaatcagaagcccacctctgaagttttgaaatagtgaatcaaaggggcttcaaactgttaatttatttttcttattttattctctcaacattctaattaaatgtatatgtaaacttgttcatctcaatcattgaggtaacaagatttttcttttattatctcttcattttattattattattactataaaagcagtagtggtggttacctgaattagctttggtacttggagtttctaagaaatgtgtctgaatacttcatttatatcctgtctaccctcttttgctattttccaaaatttgttaagttgctcacaaagtggctctcatatattgcttcatttaattcacatcctttaaaaatctgtaatatttcaaaatgtgctaatttccttcaaaagcttttgacccaccttaatggatttgatgatgaaaggggaaacactgcacatagcaagaaatggtatgaaaggaaaagcactggatatttcctgagtttggtaataactagtgcaatttatttgcaatccctatgtattaaaacagtttggctcatccaagaaggtactgcagttctctagaattaagtcctgtcatgaaaccgcttggactcatttaatgcttattgattttcataaacaaacactgaattgttgggtggttaagacaaaaacaatcgcacaaactgatatgctttctccagtatagatatggtttctccaatacagacacccactacttggaatgtcttcgtttcatggccttttcttctgatttaatactcacaaattatttcttcccagaataattttgctatcaaatacctaaaatcttaacagaaactgaattattttgttcattatactcgctttattatttatttgtcaattcctctataaaaccatgatttttccttcgtgtttctttctaagtacattgcaggtgtcagtacacttgcctttaaatacttcgtcatgaacaccatgagctagatctgaattttgtttagctttttcttttgagttaaaatatacatacaatgaattacactagacaaagtgtgcattcactgtcatttgacaattgcacacacctttataatccaaagacctatcaagcaggaggacttaagcaagtgcatcagtggccctctggaacagctctagcttactgtgtttcagactacatcggggaaggattaaggctctagcactgcagcaggaagttaaatgtctgcagtcacactgcccatgccaactgtggatcagatcttctggccgtggggtccaatgcattgcaaaggactggatcttgtgtacagtgtctctctccactttttgtacgtaagcactttagacttgaccttagtgtgcatgttttttgttttcagcaatcttgaatcatgtgctggtttcttctctgggtggcaattatctgcttttaactttggccacattcatgtcatgttctattctgcagcacattctgactatccagtgaatagggaaataagtagcataaataatcaactttgtacttctttataaagattattgtggatattcctaggtactttgaacattcatataaactttaaaatcagtttgccactttccgcccacacacacacacacacacacacacacacacacacagcttaatgtaatttagatcgtgtttgtcttatatctgtaagtcaattaggaaaacaaaattgccactatcatagattgtcttcaagtattagtaccttgaattttatgaaattcatttcctacatttaaactcacataaatcctctctacatcattgttgctattcgtgtttttgcataaggggattggttctagaaaaaaaaagaaagatgagaggatcttcaccctagaaaattcaacgttcacaaagactttccatcacatagtcagatctgtcattagaaaacttagtctcttattttccagtattggaaaaattaacatcatcttcttcttcatttttcttttatttatttattaaaattttttttattattatactttaagttctagggtacatgtgcacattgttgaagacagtgtggcaattcatcctcttcatttttcttcatcaccatcatcattgtcttctttataccattatatattttaaataaaattacagaaccaaaaacaaagtaaaaattaaaaaaaacttctacataggatgtcagaatcctaactactaaaatgaattaaaattgaacctattttcaatgtcttcacttaaaaaatatctttttttctgattataaattgaatttatatgtatttgaaaaaaatttttagaggaaggccttagaaagaaaatacaagtaacaattaaactcacaattccagggaaaaccaatgttaatatttgtgtgtacttcacagtaaactatataaaataaatgaataaaaatataggaatatttatagtaatgtacatacataaaagaatgctataccaacataattttttaaagttaaaattaggttagttatttttatcatgcttttacatttcaaaataaacaccaagtattttgatgtgtcagttaatatcctttgaaaatataatttatactaattacttttccatataaaaatgaaatatcattaatttatttacccaaagttgagaatctttacatatttttactattataaataatgctatgatatttttcccataaatatttgattaaattacttaatattactctggaataatttcttaaaaggaaactctggatcttgaccatattgccacattttctctgcagtgtggggcttgatttatcattctatattctgtattagaaggcacctgtctccacatcctcactgactgttaagtgacaccatgtttatattacaacaccttgataggtacaagaaaaaaaaatatggaccctacattcctggaagaaaaattcacagaaagagaatatacacagattaaaagacaataggattagttattaagaagatgaatacaataaagaggatgaagtgggtggaataattgtctcccagaaatgttcctgtcctaatccctgaaaccgacaaagattccaatttacatggtaaagtgaattaaggttgcagatggaatcaaggttgtgaatcagatgaccctaaaatagggagatttccctgtattataccgtgagtccaatgcaattccaaaggttcttataagcgaaggagggaaacagaagaggcagagtcaaaatgaagtgatatgagaatgatttgacctgctacctcaaaccacccttgaaaattgaaggaataagtctatgagccattaatgtgggtggcttctagaagctggaaaggaatgagaaacaggtttttcccttttaacctccaaaaagaaactcagtcctgctgacactttcgttttggccaatgaaactcattttagcctccagaactacagaactataaggtaatacatttgtgttgctttaagacactgagattgtggtaattttttacagcagccataggaaactaatagaaaagctaaaagaaaaataaacatgctatggtagtattaaaatctatattgttgccaaaacattccatgaaaatccctttcatagtgttatcttacgatccattttatttctgtggcatctgtagtaatgttgcctctttcatttctgatattgagtcttctttttttctttatctagctaacatttatgaattttgtttgtctttattttaaaaactgcttaatagtctattttaagctgataagttcaatagcacacagaaactctagaataatctctgcagtcacacacaggagctctaacaccctaccccacactttattttattgttgctgcaatttacatccattcatattgtgtctcttttaacatattttatttctttttttaatacttttgtcttttgacttttatactagaattaaaagtcattattactgtagtaatcatttcactatgtatatgtatatgaaaacatcatgttgcataccttaaatatgtacaataacatatttgtaatgaataaaaaataatagtcatttatacaccactattgcagtaatgcaatatctgtatctgtccctatacttacctttattgtcaagtttcatactttcttatgctatggtgttgctgtttagtatcccatcatttcaacttgaagaactccttttagcattttttctaagacaggtaatatactattggtgatgatctctctcagattttgtttattttaagtagtttttaatctctcctccactattaaaggccaggtatagtgttcttggttggcagtttcttttcttttagaactttgaatgtatcatcccactccctctggcctgcaaggtttctgctgaaaattcagatagtttcatggacattttcttttatatgacaagttacttttctctttatctcaaaatacactttgtttttgactttttacaatgtgattacaatgtgtctcaatgttgatttgtttgagttcatcttatttgggaacttttgggcttcatggatctgaatgtctattgccttcctcagatttgggaagtgttcagccattatttctttaaataggctttctggccccttctctcttctcctctgatacttccttaatgcttatattggtgtccttgaagaggtcctatcagtttcttaagttttctccactcatttttgttctttttactctactgactgaatcatttccaatgatatgttttcaagttcactgattgtttcttctgcttcgcctagtccattgctgaagctctctattaaataatttaattcagttattgcgttcctcagcttcaagatttctgttttggtactttaaaaatattttctatggctttgttgaaattctaacttttttcctgcatttttctcttgacctccataaacatctttatatcatattttgcattctaaatgaagtaaatcatataatgatgtttcattagggttggtttctgaagatttatctcttctttctttgtttggaacatctttgcctgtttctacgttttccttagttatctgtgttgatatttgcacattagacacagaaggtcatctctcagtctttacagactagccttgtataggaggaaacctccaccaaccagcaaagccagagattctagtccttctaataactctctctctccatgaaaagaagcaggtgtgatttttgtctactcctctgtgctgacctggggtgggaaactattgtatcaaccagtccaaactaccatttctattaatcttttatcccaggtgtctagactgtaccagacccatcagagatccaagagtggcaagtctcttaccagttctttgtgtagtcctggagaggttgggtgctgggctcatgatcaattcttttcttctctagaagaaagctgacacttgggatattttttctgcttgctctgtgctgagcaggagggagtatctatggtgtccaccagcactagcttccatctattttcttccctggtggctagactgtgataggcctctcagagctctaagactggtcagtaagatgccagttctttggagagccctggagaaatttgggtgttggatgcaccagtcaagtcttccacacccttcccaatcccaggagaaagctgagagctggaattttttgtctgctctctatgtactgagaagtagggaagatctatgctgtctaccagctcaagccccatctccattctcccacaggtgtctagactgtgccagacccattcgagctctaaaactagttagatagatgctagatcttcaggcagccattgaaaagttggagtgtcagatacacagatcagcactcttcctccacagcaggaagctgaaagctgagatttcttatctgcttactgtatgccaagaagttgggttatgggggggcagggtctgtggcatccaccagatgaaaccaccatctccatcctctgcagaaagctagattgtggtagaccagtcagagctccaactgacagacgtaattcgtgtataaagcccctttaaaaattttggagtactggacacaaatcaatctcttccaatgactgggtgaagctgggaactaggggttctctttctgattgtatggcagtacactggggacagggactccactgagaggatgttctgaatctccctaccaactttggtaactctgatttttcattttcccaggatgtggtagtcattcaattagcttcagaatttcttacaaagataatttgttcaaattgttgttgaaatatgttctggggagtaggacggtgcagaacttcccactctgccgttttgctgatgtcactctgtaggagatgcttgatcctatttaaactttctattttagaagatagttgcctttctatgtttagagtatttatattctggtgtgcttttgtgggctgagttccaaaaatgtttaattttgatagctctttcaatattattatactttactttgcttttttaattctgaaggggtttcagctcaatcattgctggtgccatctggggcagaaggccctttctaggccattcaagtcattgggccactttgacgcctgaagatggaaggaacaaaaacaacgaggctttggtcttcctatgtcatttgatagagggctaggaaatatcaagtttgatggataatacttctgtggctcattcaggctgcatttcactggccttattctacagcagggttgtatcagctaggtaggccttcactgatgcctctgaaggcagatcagttagctagttacctggttatcgaatgacggttaggttagtcatccagtgctgtgatgttgccaatatgggtggaatggacagcccaccagtgcactgaatgtggactgtgtttggtgggcctgccaagtctgaaatggccactgtgggtgaatcaacacacacatgtgtcctgactccctgactctaaagaaggggctggagcaactccccatgtctttgccgagcttttccattcttagtcatttggccagaaagtgaaagcttttctttagctattattgttattatttttgtctatgcctgttggaggtttggggttaaagatctgtctagcacccagtttgggatatacatgaaagataagaagaaactcagataactgaccttcctcaagtccaaaggtcactagtcagaatttttctttttattaaccatccttctattctctatgtccatgagttttcagagtctttttgttgttgtccattgacttgtttcagagtattaaattgtatttagaacgaaggataaggaaaaactgaaactacaaaactttgttccagagcatgcatttatcatagatgttgaataatgttcttctttaaaaacataataaagtgtaaacatattttgagtaatacttatttcactccaagaacaatcagcttcaagtcaaccattatttattacataaagaattaaaccaggcattatatgagacactaatatttgtgaaagatgcaaatgatgctcttgaggatcttcctgctgacaaggctagtgagaagaggaagttagcgaagaaacagaaaattaaataaatattgtgccatagaaaggtatatgataagaaccaaaaatttaaaataacataagaatggtttttaaaaatgtctcttagataatgttttcaactaatttatcatctgaaatggaatagaaaatctattaatgcttatgacaatttaacacgtgtaaattgaaactgtctcagaaattgaagatataagttcagcttacccttaaaaaattttgtttcaattattgtggaaatatttgcaaataattacatatttaaagaactgtatagtgaatcaatttcccaccgtttatattcaataactatctgtgtatggccaagttttattttctgtacactccctattcccttttccctatcaatatttcagagcaaattctaggcaattttttgagtcattccttgatgaaagcactaatcacttttatctcatgtttttttctctttctcctcttccccactggattctcttataagaagaatttctgtacactcatccacatgctgctttttgttttacttatagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagtatgtttctacttactcttcattgttttaaataatttgaacgtttattttttctgaaaaacttgacactttgtatttcctaaaaaagccatggcatatgtgtggcataccaatttttaacttgttgtctttcagcttccaaatcctttcttctttttcactctactttataggaaccgtatctctgctaaaccagacctcatcctatagagttttgcaacagggagaaagaataggaaattagaaatctgggagatctgttttcttcgtttatcagtatttcctgaataataggttttacactggtaacaatacttgattttaatctccccctactttttaaaactcactccagaaaaacttcattgtctgctgtctgctgtgttacactcagggttctggattccagttctttgagctctatgcaaatgtctcaaacttccagcactggctgagcaatacctattgttagaattctgagtgtgagatccatggggccagtcctaccatcttccaggttcagctaactccagtcttttccatttgctacttagcttcatgaatggaatcatttttttgcaattagtagttcatatttagtagccaattagtagcgtggtgtctaccttaacttgttctgttcttcaattgctgtttacccaattacttatatttaattatgtccctccaaaatcactcatgtggtttccctttttctgactaagctctttatagtactaatcttgatataaggatgaagcaggagtgagaaggcatcttatgctttattttttaaaatttacttttaattttcagggtttttttttatcattgcccttcactgtctctggaaaattacttaaacttatagacagtttacctcaaaataaggtgggataataataacagttctctttcaacttctgggttcctctggttataaaatgccatgaagcacagcactatccacagcagcaaagacatggactcaacctaggtgcccatcaatggtgaaatggtgtattagggttctctagagggacagaactcatggaatacacacacacacacacacacacacacacacacacagagagagagagagagagagagagagagagagagagagagaaaggggagtttattaagtattaactcacacaataacaaggttccgcaataggccatctacaggttgtggagcaaagaaagcccatccgagttccaaaactgaaggagttggagtctgatgtttgaacgcaggaagcatccagcataggagaaagatgtaggctgggaggctaggccagtctctcttttcacatttttctgcctgcatatattctagctgtgctggcagctgattagattgtggcaacccagattaagggtgggtctgcctttcccagcccactgactcaaatgttaatctcttttggcaacacccacacagacacacccaggatcaatactttgtatccttcaatccaatcaaattgacagtaataaccattgcaagtccaccccttgtcaacttgaacccatacacatctcttgagatcatgcataatcttcaaataaagacaataatacagtcataattatgcctaaaataatacaactatcctttgtacaactggaaacgcaccaatctccaatccaaatactattacataaaattaacaatacttaaatgctgatatgaagtcaataaatcttgtcacatgataaatgagaaaagaaataaaatgaagatattttcttagtacaagtgtatacatgcacaaaaacgttttcaacaaaagaaagaggaaatactcatgacaatttcagtcctcatttctgcagctggtcacgtggtcatggctggtattgatgactaccttctactacccattctgtattccctttgcctttggcaagcacctcagcaggcccttttatttttttttaatttccctggtggagtgacccaaaccttcattcctgtggggtctggtcatttgtagtcttgcctggattgggctgttgtagtttcccatttaccttaatcacagagcatggtaatactaagagacgccctaatggatctcctgttttccatgcatactcttccttacctccattgtggagtaatagactgatttcctcttaatagtctgggtaaatcaccccagccaacactgtaactcccttcttagcctgttgacttaaagtaggaggagcccaaagtgtccaggtggcgatcttcatttccagtttaatggaatcgttgttgtgtatcctggtggcagcattcctccctctggaacgaagacctctgggccagcagaacgtaatgtcatggaaacaggaagcaaaaattttgctagtggatcactatgggtaatggtgagtggtgtcacttccaccccttgattccttgagccatgaatcctgcctacaggagaaacagtaccatatatcggatgctgattcagagcacatacagccttgtggagaactttgtcccagtcatgaaaagtatagtcacctagttggcattgtaattgtgacttcaaaaggccattctaccattctatcaatccagctgcttcaggatgatggggaacacggtaagaccagtgaattccagaagcatgagcccactgctacacttctttagttgtaaagtaagtgccttggtctgaggcaatgctgtgtggaataccacgatggtggataaggcattctgtgagtccacagatggtagtctggcagaagcattgcatgcaggataggcaaatccatatccggagtgtctattccagtgagggcaaacctctactcttcccatgatggaagaggtccaatataatcaacatgccaccagggagctagctgattaccctgaagaatggtgccaaatagagggctcagttttggtctctgctgctggcaaattgggcacccagctgtggccttagccaaatcagccttggtgagtggaagtccatgttgctgagcccatgcataacctctgtccctaccaccatggccgttttgttcatgggcccattgggtgatgatggggtggctggggaaagaggctgggtggtgtccacagaaagagtcatcttatccacttgatcattaaaatcctcatctgctgaggtcacctgttggtgcactcacatggaatacaaatatcttcacagtttttgaccactcagtgagttccatccacatacctcttcccaaatttctttgtcaccgacttttcaatcatgcttctcccaagtcccagaccatccagccaaaccattggctacagcccgtgaattagtatataattgcacatctggccattcctccttctatgcagattgcacaaccaggtgcattgcttgaagttctgtgcactgggaatacttcccttcaggtctatgcttcagagatgtcctagaaagggtctgcagtgctagagctgtccactttcgggtgatgcctgcatatcatgaagaaccatctgtgaatcaggccctagtcttctcttcctctgtcaactgatcatagataactccccatgaggccattggtgcaggctggggaagagaaggcagggtggcaggagtggagaccatgggcatttgagccacttcctcttgtaacttacttgcgccttcaggacctgcttgagcccgatcacatacataccacttccattgataatggaatgctgctgtgcatgacctaatttatggctaaatgggtcagaaagcacccagttcatgaaaggcagttcaggtcacatggtgacttgatgacccatagtcaaacattcaatttccaccaaagcccagtagcaggccaagagctgtctctcaaaaggagagtagttatctgcagaagatggcagggccttgttccaaaatcctaggggcctctgctctgattcacctatgggggcctgccaaaggctgcgaacagcatccctatcagccactgacacctcaagcaccactggatctgtggggtcatatggcccaagtggcagaacagcttgaacagcagcttggatctcttgcagaaccttctcctgttctggatcccactcaaaacttgcagcttttcgggtcacttgataaatggcctggagtaacacacccaactgaggaatgtgatgcctccaaaatccaaataggcccactaggtgtggtgcctcttttttgattgtaggaggggccaaatgcagcaacctatccttcatcctggaaggattatctcgacagtcccaacatcattggacccctagaaattttactgaggtagaaggttcctgaattttagtcagattaatttcccatcctctggcatgcaaatatctcaccaataagtccagtgtgtttgctacttcttgctcactggctccaatcagcataatgtcaccaatgtgatggaccagtgtgatatcttgtggaagtgaaaagtgatcaaggtatctctgaataagattatgacacaaagctgtagaattgacataccccttaggtagaatagtaaaggtatattgtgagccttgccaactgaaggcaaatttcttctggtggggctttggacaggaatggagaaaacaaatttgccaattcaatggctgtgtatcaggtaccaggagataccaagaccagctcagccgaggagaccccagcccagcagcgctagaggaattgaagacaaagacacagaaatagagtgcaaagtgagaatcagggggctaacagccttcagagctgacagccatgaacagagtttgacccacatatttattgatagcaaggcagtgataagcattgcttctatagattatagattaactgaaagcattccttacgggaaacaaagctttcttagtgaggagaagagaaataagctttggctgattatctgcagcaaaaatatattgttaaagtacaggccactcctgctgttgtttgtggtttgagcagttttccactccgggtgggccaggtgttccttgccctgctccagtaaaccaacaacttctagcagtgtgtgtgatagccatcaagagcatgtcacattgctgcagaaatcctgtttctggccagtttctttaaggcccgtttgtgacaggcttagggattgttcccagcatgtctgcctttctgtttttgcaaagcaataaaggcaaaggcagctttttcacagtgggctacttcttgcagaatttaggatccgcatctgcagactacacaaagacaacaccaattaaaagcacaatcatcattgaaatcacagagcctccgagtgtcttggtccgttttaaccagttaatagctgctaatccatctgcagctccttcaaacacttcagttcctggcattagcgtcagatgtgcctgagaggcttgaaatacttgttccttcagttttgcaatatccaaagataaatttccagtatgaccctttaaatgtctcttaattatttcccactcatgctctgtttcattatacaaatgaggagtaatgcaaaaatcagaagtattccagtcacattgtaactgtattctatattctaaactacttactcgatctcctagccacattacaatttatcggagatcattgatttgattagctagtttcaggtctatattagtttgggaattccacagcagagtagaatttaaaaaaaaaaattttttttttttgtatttattgatcattcttgggtgtttctcggagagggggatgtggcagggtcataggataatagtggagagaaggtcagcagataaacacatgaacaaaggtctctggttttcctaggcagaggtccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagttgacacagcacatgtttcagagagcacggggttgggggtaaggttatagattaacagcatcccaaggcagaagaatttttcttagtacagaacaaaatggagtctcctatgtctacttctttctacacagacacagtaacaatctgatctttctttcttttccccacatttcccccttttcttttcgacaaaactgccatcgtcatcatggcccgttctcgatggttgctgtctttttggagcagttgggtacacctccagaaatgctgtcacttcacacttggaagattgcacagcagccaggcagaggcgctcctcacctcccagacagggcggctgggaagaggcgctcctcacttcccagacgggaattccacagaagagtagaatttttctgccaattatttacatagtctgctgtttgtactgtggaatgctaagaaactccagctaccatggcagtagctgtgacagcaatcaatcacataatgattaaaattaaagtagcaatgaaacaccaagagcgcctcaaaatcttttgaagaatttcagtaataatatgcacagaaggagagacttccaaaggatgggaaattcttacaggtatccatactccttctcaggctcttaccgctaaaatagaatgatcagtattatacaaggaagaattcacacaagaagacaatatacattattaacaagtcacatgatgattagtgagatcaagttttaaatcacccactacaagcaggaaagaggcctcattatcagtctcgacatggttgcaactggggagtcttcggggtgcctcccaaatctcttcctcagcatctggctcatgataaggtttcaggtgtcttgatggtatccaaattggctgctagttttggcctggagaaacacaagcataacctctaccccatattattttacctatttcccaactttttgttattggatctctccaccaaaccggttgttctgcttctgtctttgctgctggtttctgtagatgctgttcagttgctgatagcatctggcctttagataggctcaaaaaatttaaagtcaataatgctagattcaattgcatatgtggagtcccatattcactgtttccccctttttgtttttgtaactactgttttagggagagattcattctttccacaatggcttgtccttgtgaattatatgggatgccagtaatgtgtttaatattccttacagagaaaaatgtagctagagcttggctagtatagcctgaggcattgtccgttttaactgaatctggaatgcccatgactgtgaagcatttcagaagatgccatttaacataggcagaagattcccatttggcaggagcccaaacaaactgagaaaatgtatctatacatatatgtacataagccaatttaccaaaggaaggaacataagtgatatccatttgccaaagagaattaagttccaatcctcgaggattaattcctcttgtaaaagatgaggaatgcaccatttggcaagttgggcatcactggataatagctttagctcatttctgggttatgctgtatctgtgtttgagaccagaggtgttaacatgggttaaattgtgaaagtgtttagcattagataatgcagtagcaactagacaatcagccatttgagtcgctgcagtcaaaggtcctggaagagatatatgagccctaatgtgagtgatgtaaatagggtacattgtactcctaactgctgtttgcaattgggtaagtaaagtcatcagttgctcatctgtgtagaatcgtagctgagcattttcaactaactgtgtagaatgaaccacatatgaagaatcagaaattacatcaacagacatctcaaaagcagtcagcacctcaattacagctaccagctccgctttttgagctgaagtataggatgtctggaaaactttgctttttgatccagaataagaagctttaccattactagattcatctgtaaaaacattttcagcaccttcaattggtttaaatttagttattctagggagaatccaatgagttaatttcaaatatggaaataattttgttttcagaaagtgattatcaagaacacctatgaaatcagctaaatgggcttgccaagtaagactatttataaaggcctgttgtatttgtgccttcgtaagagggacaataatttttccatggtcatattcatgtaatttaacaatttgagttctcccatttcctatcagagtagcaatttgatccaaataaggagttagagtctgtgaattagtatgtggatgaaaacgccattctaccaagtcctgctcttgaacaataacaccagtaggtgaatgctgagttggaaaaatcaataagtctaaagtcttttctggatctattctatttatttgagctttatgcacttgcttctcaatcagctgtaactctgcctgagcctcctttaattgctgagggctagtgagactaggatctcctataaggatagaaaatagattacttatggcataggtaggaatgcctagagcagattgtatccaattaatgtcccctagtaatttttgaaagtcatttaatgttttcagttgatccctatgtatggttactttctgtggcacaatggtagtgccatttactaaggtccccaagtaggagtaaggggtagtagtctgaattttgtcaagagctataattaaattggcatgagaaatcgagttttgcaagtgatcataacattagagtaatatttcccgagtgggggcagcacaaagaatattatctatataacgaataatgtaacaatttgaaaattttttatgagtaggttcaattgcttgtcctacataagtctgacaaattgttggactgtttaacatgccttgtggcaacattttccaatgaaaatgcttatcagattgcaggttgtttaccgcaggaattgtaaatgcaaaccgttcatagtcttgctcagctaagggatagtaaagaaacagtcttttaaatccatgactattaaaggccaattttttggaatcatagcaggagaaggcaatcctggctgcaaagcgcccatagattgtataactgaattaatggctctaagatctgtcaacattctccatttacctgatttttttttttttaaataacaaagactggagaatcccagggggaaaatgttggagctatgtgtcctttttctaattgttcagtaactaagtcctctaaagcctccagtttctctttactcagcggccattgttctgtccaaattggcttatctgttaaccattttaaagatataggttctggaggcttaacaatggctgccatcaaaaatgatatcctacaccttgatgaggattctgtccttctgcttgaagtggtttctttaacccttgtaaattttttcctaatcccataccagggacataccccatttcatgcatcatatgttgactttgagggctatatagttgttctggaattaacgcttgtgctccccattgctgtaataaatctcttccccataaatttataggtacagaagttataattggttgaatagttccaggttgtccatcgggcccttcacaatgcaaaatataactgctttgatatacttcaggggctttaccaactccaactatgttaaatcgaacgggtggaattggccacatggatggccagtgctgtagagaaatgattgaaatgtctgctcctgtatctaccaatgctttaatttttttccctgaatagttatttcacaggtaggacgtttatcagtaatttgattcacccaataagctgctttgccttgtttattagtgcttccaaatcctcctgtttgtttagtttcacttttccccatttccacatatggcacaatcaggagctgtgatatgcgctctcctggccctgctttccagggaacagaagtagatataacaatttgaatttccccattgtaatctgaatcaatgactcctgtttgcacttgtaccccttttaaatttaaactagacctgcttagaagtaatcctactgtccctgctggcaagggtccacagactcctgttggcactttttgaggaggttccccaggcagaaggctcacagcttttgtacagcataaatctactgcagcactaccagttgtggtgggggacaggcattgtacaggggtgagggaatggcctgagctgggaatgccccagtttgaaccggggcctgggacaggcccctcatggcatttcctgaaattgggttcccatctttatcaaacttacagtgacactgattagcctagtgttttccttttctacattttggacatatttcagactcagcagttttcttttttcccccaactggcggcctgacttgctgattttttctacattcttttttggtatgaccatgcttcccacagttaaaacaagctccaggaaatggggtatttcctttacccaccctcagtcctgccattgcctgggctagcagagtagccttaatgcagattacctccaaaaccatcacaagctttaatatagtcaactaaatgtgcttttgctgtaataggtcgcagagtggcttggcactcaggattggcattgtcgaaagctaataaccgcaacactatatgctgagcagctgaatctgcaatcacctttttaagagactcctgtaactgagctataaaatccgcatacggttcttttggtccctgtttgacagcactagaggaagggtattgttctcctcctgaagtgatttttttcccaagctctaatgcacactgctctaagctgctctatggcatcatcctgcatgaccacttgtgcatctaaaccagcccagccgctgacccccaaaagttggtctgcagttatattaatttgaggttgggcctggacattgtgagcagcctgagtggaaccttcctctgcccaccaagttttaaattgtaagaactgagcaggagttagacaagctcaagtaagagcaccccagtcagtaggagtcatctgactgaagacagcaacattctttaacagtctcattacaaaaggagaacctggtccatattgattaatagcttgtttaaattatttaagtattttaaaaggaaaaggctcaaatgtagctataatattcccctgttgatcaggtctatgtattctaacagggaactgtcaagcatctatatcaccctctcgtctagcttgctggattcctgcctgaatagaactgagagtggtcgcttgaggcgctgctcgaacagtcactagggcaactacttgttgcccagtgtcctctggaaaagaaagatctggagggtcaggccactccttttcttcaaaataatgagggtgtgcagaggagtagggacaaacctctccctcctttaccgctttagttggcaagcaaacctgctctggtacttcattatactctccttcttcctctgattccttctcctcatcatctgtgtggaaaggctccaaggctgaacgaatcagagcccatactgaccagacagttataggaatatcctcagcaccatccttatatgcctttttcagtgtgctgcctacattttcccagacctctacattcatagttcctcagtccagaaaccaggggcaatatttctctactgcactaaaaagctgtgtaagtcagctagtgataactttcactcccccttttctgaggagcttccaaagcagactcaaataagccttgtgcctgctcaacccttgtcccattgttaccctggtgcttctgagttcctcttcttacttaccacggagattgcttaagagtacttgggtgtcctccagcatagttccacgttctccaaccatcactctggcgatgcttcaacccgggttcaggcccctacgttggacgccacttaccgagacaagctcggttgtggagaccccaacccagtggtgctagaggaattgaagccaaagacacagaaatagagtgcaaagtgagaatcggggctaacagccttcagagctgacagccacgaacagagtttgacccacatatttattgacagcaagacagtgataagcattgcttctatagattatagattaactaaaagtattccttacaggaaacaaagctttcttagtgaggagtagagaaacaggctctggctgattatctgcagcaaaaatatattgttaaggtacaggctgctcctgccattatttgtagtttgagcagttttccgctccgggcgggccaggtgttccttgccctgctgcagtaaaccaacaacttctagcagtatgtgtgatagccaccacgagcttgtcacattgctgcagaaatcctgtttatggccagtttctttaaggcctgcttatgacaggcttagggcttgttcccagcaaggagatgttttaattttctcaagcaatgaaaccacatttggtacagcagctgcagttggaatcaccacttggttaagcttaccataatccactctcattctccaagatccatctgtcttctgtacaggacaaataggagagttgaatggggatgtgttgggaatcaccacccctgcgactttcaagtccttgatggtggcactaatctccacaatccctacagcgatgcgttactgtttttgttttactatttttccaggtagaagctctaaagccttccatttggcctttccaactataatagaacttaccctaccagtcagggagtcaatgtgggggctctgccagctgctaagtatgtctatgtcaattgtgcattctggcactggggaaatgaccacaggatgagtctggtgacccactggacccactgtaagttggacctgagctaaaactctattaattacctggcttccatgagcacttactttaactggaggaccacagtgaagtttgtggaccccttagaatcaacgtcaactcagagccagtgtccagtagtcctcaaaatgtctgaactctttccattctacaatgcacagttaccctggtaaagggctgaaggtctccttgggaaatgattggagaaagattcactgcaataattgtcagtaatgtagtgggatctttcctcaaggggacccagactccccttcattcaaggggttctgggtctgtaaacaggaaccccaagtctggaaattgattgaggccatgattctctgtttttataattcaaattactctttcatcccttccacctagaagttttttgcttatataaattaagtaggaatgcagtaagcttcctatcaatttcacttctaggaacaccattgttaattagccaatgctagagctctacacaagtcagactattctgattgctgttttgtctctgctgtctattatggtagctatgcccacattggctatgatggttgagtgctgccttttggcccctggcacctcgggatccatttattcccattgtatttaaattttgtagttgagtgactgcagttcccactgttagatctgacatacagaaaagagcaattacagggcacttcaaagatgcaggtgctgtcctcacaaatctatttcacaaggcatcagtcaagggtatatctcctggatcctgccagctgggatgagtagatctaaagtgactaatccactccaccatctcaatctccctaagcctttggatcccttcctgcatattaaaccaaggcagatcaggcatttccagcttgctcacagtgggtgatcttttaatccgtatttcagctaaccaagcaaataaactattagaatttttttaactccccaagctgcaacattaaatgtggagtcctaacttagtgggcccaaattaataaatgcagcctgatccaactctatgttccttccaacattatttcacacccttaatatccattcccatgcctgttctccaggtttctgtttatataaattagagaactcaagtgggtctttttgagtatagcacacctcctcatgggtcacactctaacctcacctctaggggtccttcaggactttagtctagttataggtctagaagcaaacaggagtgttggaagtggctcctgaggagaatcaacattatcttgcttggcaactgcctcagaggaggccaccactgttgcctcagtcagcacagggtttatctcctcagacaaaggtgaaaaagctgatgccagcacgggttggagaggggatgttgccactactgaggatggggaagctgtttcttatgacaaaaagggttcatcagagtttacactcagtgttcacagcttcaacagggtcctcctacacgttcttattccaagttgcaaggtcccattcttttctaatcaatgccctcactttaacagtagacacctggtgaggctatgcatgcacccttcattgcaggtcagccacttgcatgataagaacttgtgtctgttattccataattgcagctctttccctactgaagctgggagatagaatctctgagttcatcattttctttcatcactttgtccactgaacttaggagcaaccaactaacatcattatttccttggttctccacatatggtcaaagttattgtgtcactaaattccttgcctctcacgagtgatgaatcaggagtgccacatgcatttattttgcataacgctctaaacagttcatgtcaagaactatcagtgttctccctactattagacgtaaagtccttagcatttttgggtctaatcgtgttaagcagccaagtccagaaacctccaaaccaatgaaagaactccatccttaatattatgttcttctagaaccacttctggtaccaaaatctatattagtcagggttctctagaggaacagaactaatggaatatatattccactttatatgtatatgtacatttctatatatatctcatacatatgtaacccatgtatatgggagtttattaagtattaaagcgtacattcacaaggtcccacaataggcagtctggaggttgaggaacaaagagagccagtctgaattccaaaactgaagaacttgggagtccagtgttcaagggcagaaagcattcagcatgggagaaagatgtaggctaggaggctaaaccagtctctcttttcacatttttctgcttgcttatattccagccatgctgccaactgattagattgtgcccacccagattaagggtggttctgcctttcccaacctgattcaaatgttaatctcctttggcaacagtcttacagacacacccaggatcaatactttgtatccttcaatctaatcaagttgacacttggtattaaccatcacaaatggataaagaaaatgttttgaatatgccccatggaataatatgcagccacataaaataacgaggtcatgtcatttgcagccacatggatgcagttgaaggccattattctatgtgaatttttacaaaaaaagaaaaccaaatactgcatgttatcacttataagtgggagctaaacactgggtacacacagacacaaatggagaacaagacatgggactagaaggggaaggagtgaggaagaaaggcaggagttgaaaaactacctattgggtattatactcactacctgtgtgacaggatcagtcatatcccaaatctcagcatcatgcaatgtagccaagtcataaacctgcacgtgtaccccttgaatctaaaatgaaagatatacataaataaataaataaggtacttatattttaggtagactgtagtaactctagaaaagcaagtgattcttctaggggaaaaactataccatgccaaatcaattaaaaaattattttaaatggatgaaggaggatttaaatgaaaagcagaaggcgccataattgcagagaagggaaaacaattctgaactgtcagcactttctttccttggaacatatgatgtttctgaatacaagttaaatatcagtcttggccaacccagttagagttcctctattgagaaaagagaaacctgaagaccccttagtgcctagaaaagattagattgataaattttaaattaagggatatcaaactcagtatcagtttttcttatgccacatttgttgagtttacatcctttgagggaggctgaggaggcagggtgaagctcttaaggcagaaatttctataatcctgttgtacttgggaaacaaagatcgaatggaaagaaggcttgtctcaagcacatgtgctgcctcccctttaaaacatttacctggttttgaataagcttgggacataggctagaggactgagatttgaagctctgagtaccagaaatcaatcatttactgtatttcaaagctgagaaaatagagttattctggctcttgagagaaattctgtagagtatctgagtcttactaaaactacacttttttgcctaatttaatttaaaatgtgctgaagttgtcagttactcagccctttttcaaaacagaagatggaaacttcctaagtcgaaagcaataccacctaaagcttctactgctttattaaatagaacataaagcatacaataaaaactgcacatagcaaaagcaaaaagttatggacaataacacaaagaaaaaacaacaaagatagaaaaaagaagccagaagctaagagatgatctatagagtcaaaaaggtgataacacacacacaaaaatcccactgttagagaaaatgaaagaaaaatgaacaaattacatgagggaagatagattcatttcaccagaaaatctgattctatagatttcacttgctatgtatatatttgataacaaaatatgtaaagaaatcagtaaatcatttgaattataggcctcatagttaaaaatactggattagttaactagaagaagagataatgaaaaacatctcaactgacagaacaaaacatttaaaaaatagtataagtaataattacaccatattaaaaagcctaaaacccataaaatagggaccaatttgtggaaaacaaagagaattgaataaaagttatgtaaaaacatacaatgcctgagaattttctaaaagtatggaatgatatcatcccattcaagcagctcactgaattccaacaggataaacacaaagaaaacacacctggtcatagtaagactgttgaaaaccagagacaccgagaaatcttataaacagccatagaaagaaggcctatattttaaaagacagcatgataagattgatgggtggcctcaaaaaatgaagtgcagaagacaacggaataaaaattgtatgccataaatataaactattgacctagttacttgttcttcaggtagagtaagtaactaggtcagcagttatatttaagagcaagacatcatcaggaaatgtgaatgtgaagatggcaatgaagtacacaaggtagagtaaatttgtgggtatatataataaaaattaactgcaaaaatcaatattaataatatcttatagattctaaaacatatgcaaaacaaaaatgcaaaataccacaaaagttgggaggcatgtaagtacacaaaaggttctaagtttccagtagtaataagaaatggtgaattaatgatatatattatattatattatattaatgtgaggatgcatgattcaatttctagtgggaccattaaaataataaaaaatataaatataagacacagaaaaattataataaatatttgatgactataaatacaggcaagaaagaagggaagcaaacaagacatttgtaaaaataagcaaacataactggtagatataagacctatgtaaaatagactaaataaagcaaacaattttgagatatttcacaatgaaataagtgtgctagcattttgctgcttataagacatgtaattttaaaataacaacacagagcatgaaagtgtgtgaaaatttttatgccttgcaaattttaaccataagaagatggaattctactaatattagataattaaggatttatggaaagaagcaagaatagaaataagaaaatatgttgcaacatatcattccccctcatccagtttcactttctgtggttttgctttctgtgatttcagttacccaccgttaaccaagtgaagaaagatgagtacattgtaagaagatattttgtgagagagagggaaagagaccacagtcacataatttttattgcagcatattgttaaaatgttctattttattattagttgttattgttaatctgtcagtgtgataacttataaattaaaacaatcatacatacagggaaaaaacatagtatatacaggggtccatactttccccaattcaggcacccactggggcttttggaacatatcccatgtggataaactgggtctactgtatttatctgcaaacataactttaacatatatggggaaaatttgaaaatagacaaattcacaatcatagagattaacccacttcctcaacagtggttgaagaagcagagaaaaatctcttaagaagagaagatcttcaatatataattgtaaacttgatcatcttatatgtatagtacaaaaagacttcaaaatgttcacggaaaatggaataaaaagataaaaagtataaactttatttctcaacataagctctatcaaggtcaagacagttttgtaagtgatgatagcagccatgtagtccatccctgaagaacagaaggtcctgagattttaaccatgtcaaggcaatcttttttacattattaactgaaggaaaaataggtgtcctttaaatattttgttaagattaggaaacaaaaacaagtcagaagaagtcatatcaggactataaggtagatgcctaactttcttactgaaactgtcagaaaattgctcttgtttgataagatgagtaaaagcactgtcatggtggagaaggactctctggtgaagttcttctggatgttgttttctgctaaagtcttggctaacactctcataataagcagatgttattgttctttggccctacagaaggtcaacaaggaaaatgacttgagtaacccaaaaaaactgttgccatggcctttgctcttgaccaatctgcttttgctttgacaggatcacttccacttcttggtagccagtgatttgtgctttgtcttcaggatcacactggtaaaactgttcatcttctgttacaattcttcaaaaaaatgcttcaggttcttcattccttttgtttaaaatttccattggaatttctgctcttgtctgcagctcatctgggtgcaatggttttggcagccattgactggagtgtaaaatttcctcagttttaatgtttgagtcagatttgcataaggtgcaccaaacgagacatctatagtgctcgtcattttttctgctgttaatcattggtacttttcaattagggcatggacaagatgagttttttttttttttttttttttccatgcaaactgatgtggatggtctgctgctgtgggcttcatctgcaatatcatcttttcccttcttaaaatacatttgtccacttgtaaactgctgatttatttgagacatcatccccataaacttttcacaaagcatcaattatttcaccgtttttacactcaagcttcacaataaattggaagtttgttcttgctttaattttatcagaattcatgttgctctgatagaggctcttttcataccgatgtcttagtgcttgaaactagatcctcttaaggcatgttctaacaagttaatatgagtgtattttggtgcaaaaaatcttgaaatccatgtgtagttttttcaaaatacacattttaatgaactttttgaagacccttaacatgtgtgtgtgttcacagttgtgaacttgattatatgtaatatatcagtgtgccccaaactgacaaaactcactttagttcaacttcatatggtctgtttaatgcaataaacaatgtatttagccaaaatatgtctcaataagttttgtaagtttgaaatgatgaacaatgttttttctatctacaataagattaagtggtaagtcaacagcattaaagataatgcttccaattccttggaaatgacagattccatttctaattaatgtataggtaaagaagaaatcagaatggaaaccataattttttaactaaggtataagtatgcacaacatatggaaacaccataggattaaactaaagcagtggtttaaggaaaatgtatagccatatatatactttaaaaaaatactgaaaaaataccaatgatttaacttttcttgtcgagaagtcaggaaaataacatattaagtctgagaaaattagaaatatagccataataaaactaggagaagaaacaacaaaatatgaaacaaatgcaaaatattgaaaataaatgaaagcaaaatttaatcaaatacactttgaaacataaaagtttaaaaacttatgaaaacatgagctaaaacaatagcagaaatgaaaagagaacaccataacacagcctatacaatttttggaaggaacaacatttagcaaataaatttgacaattttgataaagaagtttattgaacaaaccaagatactagccgacattaacaataaacgttaaagacactaaagaatgagcattacaaagaattagccagtctcaggtaagtgaatttttccaaaaataaagaaatgtgcatcatttttaaaaacttttattttaatgtccagggcaaaaatgcagatttgttacacaggtaaacttgtgttacgggggtttgttgtacagattatttcatcacccaggtattaagcctagtacctattagttgtttttcctgatcttctctctcttccctcccttcatcctcaagtcgtccccagtgtctgttgttcccctccttgtgtccatgtgttttcatcattttgctcctacttataaatgagaacatgcagtatttggttttctgttcctgtgttagttgcaaagggtaatggcctccagctccaaccatggccctgcaaaggacatgatctcattttttttaatggcttcatagtattccataatgcatatgcactgcattttctttatccaatctatcattgatgggcatttgggttgattccatgtcttgctattgtgaatattgctgcaatgaggatacatgtgcatgtatctttgtaataggataattatattcctttgggaatatacccagtaacgggactgctgggtcaaatggtatttctgtctttaggtctttcaagaatcgccacactgccttccacaatagctgaactaacttacactcccaccaacagtgtataagcattccttttcctccataaccttgtcagtatccgttattttctgacctttcaaataatagccattctgactggcatgagatggtgactcattgtggttttaacttgtatttctgtaatgatcagtgacgttgagctttttttcatatgcttgttggccacatgtatgtcatcttttgaagtgtctgttcatgtcctttgcacacttttttatgtttttttcttgtaaatttatttaagttccttataggtgctgtatagcagaccttcatcaggtgcatagtttgcaaaacatttctcacattctgtaggctgtctgtttgttctgttgatactttctttttgctgtgcagaagctctttagtttaattagattccatttgtcaatttttacttttgttgcagttgcttttggcatcttcatcatgaaatctttgcctgtgtctatgtgctgaatggtattgattaagctgtcttccgaggtttttatagttttgggtcttacatttacgtacttaatccatctgaagttaatttttgtatatggtgtaaggaagggatccagtttcaaccttctgcatatggctagccagtttctcccagcaccatttattgaatagggaatcctgccaaagatcaaatagttgtaagtgcatggtcttactactgagttctctattctgttccattggtctatgtgtctgtttttatactagttcatggtgtttaggttactgtagtatagtttgtggtcaggtagtgtgatgcctccaggtttgttctttttgcttaggattgccttgactattcgggctctttttatttttggctctatatgaattttaaaatagttttctctagttctgtgaagaatgtcaatagtagtttaataggaataatactatttttaaaagcaccccaaacccaaagtacttaggtagaaatcttaaaaatataaatatattcagaatctatatgcagaaataaaccaaatgttgattactgaaatcaaatatctaagcacatagagatatagttcatattcattgatcataagattcactattgttaaaatgtcagttcttcccaacatgatctacagattcattgttttctcagccaaaaatcacatcaaggtttctagagatacaaactgatcctaaggagtactcagaaaataaaaaacctaaacaaccaccaaacatacttgtattactgaagtcagaattacttattttaatattatatatcattaataaattttttgttatagttaatatttttgtctaacttttatattagagttaacattaatttatgcaccaacattagtgtcactactgtgtgtctatatattacatttactggtaaaatacccttttatatgcaaaatcattagcataattttgttcccattttaaaaactctcaagtttttctcgtaaggaaggtctggtaacgattctgtcggtgtttgtttggcagaagattttacctctccttcattttaaaagattgttttgctgggtatagtgtttatgattggcagtttgtttcttttcattaagtactttgtatagattatcccactctctcttgaactgcaagatttctcctgagaaatcagttgataatctcacagaggtttgcatattacaaattgcttttctcttgctactttcaaaattctgtctgcttttgacttttgccaacttaattgtaatgtgtcttggtgtaaacatttttatgttcaacatatgtggaatcatttgggcttcttggatctttgatcttctaagatgtccgttttcttctccagattaggtaagttttcagtcattatttattttaataaacttcctgcccctttgtattctctgggtaaacttctattatgcatatattgcatcacttaataatgtcacataactccacttccttctcctttctattctctggggaaacttctattatgcatatattgcttcacttgataatggcacatatatcccataggctttcttcactatttttcattcttttcttctcttttctcttctgactatataatgtcaaatgacgttgcttttagttcactatttttttcttctgcttgactgagtctactgttgaaactctttattgcactttctattacagcacgtgtgtgtgtgtgtgtgtgtgtgtgtgtgtgtgtgtgtgtgtgttgagaaagggtcttgctctgttacccaggctggaatgcagtggtataatcatggctcattgcagccatgacctcctggattcaagcgatcctccaacctcagcctcctgagtagctggaaacacaggtatgcactgccatgcccacctaattttttaaaaaatttggtagagacagagtctcactatgtttcccaggctattaactgtatgaactccaaaaacgggctcttttatgatttttaactcttttttaaacctctaattttgtttatgtgttgttgtgttgaaattgctgatttgtctttttgtgttatagcttgctgagcttctttaaagcaataattttgaattatttttggcaactcagatctccatttctttatggtttattagcagaaatttgtgttcctttggtattgtatgaatacttttttgtgttccttgtagccttgtcttagtgtttgatcatctgaagaaggtggctcctcttccagactttacagactagctttagcagaaaaaagccttaacctgtaaaaaggcttgagggcaacaactttatgggttttgtggtggttccaggtgcagaggggcatgacaatgctggtcctgtgggagaacatgggagctatttccaggggttgcacagagatgtcagttggcggggttgggttaaggcccagggctatgaaaacagggaggtattatggcataggctccacatggctccagcagaatctagtcggagacagtctcagacggagatgaagaacttgttgggaactggagcaaaggtgaccctttttatgttttagcaaagagactggtggcattttattcctacccttcagaattgtggaactttgaacttggaaaagatcatttagggtatccagcagaagaaatttcttagcagcaaagtgttcaagagctgacttgggtgctgttacaggcattcagttttaaaagggaagcagagcataaaagtttggagagtttgcaccctgacaatgtgataaaaaaggaaatcccattttctgaggaaaaatttaagctgactgcagaaatttgcataacaaggagctgaatcttaatcaccaaaacaacaagaaaaatgtctccagggcatgttagagacctacacagcagcccctcccatcacaggcccagaggactaagagaaaaaaatggcatcattggttgggcctagagtccctctgctgtttgcagtataagcatttggtgctctgcttcccatctgctccagccatggctaaaaggggtgaaagtagagctcaggccatggcttacaggcaacaaaatgaagaaaagatagcctttccaacaaatggtgctgaaaaaaaatatatacatgccaaaaatgaatctagatgtagaccacacacttttcacagaaataaactcaaaattgatcatatagctaaatgtaaaataaaaaattatacaactaatacataaggtaggagaaaatctagataaatttgagcttgattataactttttagatataacagcaaggacacaattcttgaaagaaagaattgatagctggacttcattaaaagtaaaaatttcttcttttataaatgcactgtcaagagaatgaaaagagaagacagaatgggataaaatattttcaaaagatgtttctgacaaagtatcgttattaaaaaatagagaaataactcttaaaactcaaaaataagaaaacaattgattaaaaatatgccaaagactttagcagacaactgatgaagaagatatacagatggcaaacaaacatgtatgaaaagatgttccacatactatatcatcagtgaaacgtaaattaatacaacagtaacataccatattacatattacgatggccgaaatctgaaatgctgatgacatcaaatgttagtgatggtgtagagcatgatagactctcattgatttttggttaaattcataatattaaaaaactattgcaatacatttgtcagtttcttaaaaatgtaagcttattcttccatatgatcagcaagtgcactccttagaatttattcaaaggaggtgaaagcttatgtccaaacaaacatctgcatgtggatattatatcagttttattcataattgccaaaacttagaagatgtccctaagtaggtgaacagctaaataaggtgtagcatatccagacaatgtagtattattcagctattaaaagaatgaaatatggcctggcgcggtggctcatgcctgtaatcccagcactttgggaggcagaggcgggcggatcatgaggtcaggagatcgagaccatcctggctaacacagtgaaaccccgcctctactaaaaatacaaaaaattagccgggcgtggtggcgggcgcctgtaatcccagctactcgggaggctgaggcaggagaatggcgtgaatccgggaggcggagcttgcagtaagccgagatcgcgccactgcactccagcctgggcgacagagcgagactccgtctcaaaaaaaaaaaaaaaaaaagaatgaaatatcaagctacacaaaaatacgtgaaggaaatttaaatgcataagatttttatgaaacttaaatgcataatcctttgctaagtaaaggaaccaattttgaaaagatcacatactgttttaatgcaaatacaacagctaaaattgaaaaaaactatggagacattgaaagggtcagtggttttcaggtgttggtggggaaggaggaataaacagaacagcacagaggatttttagagctgcgaaaggactttctgtaatactacaatgttggatatatgtcattatgtatttgtccaaacccatagaatgtacatcaagagtgaaccctaatataaatgatgattttggggtgataatgtgtcaatatagattcatcaattgtaacaaatataccactttggagagaaatgttgataagatgtgtgcatgtatgtgagaaggagctatttggattatctctctaccttcccctcaattgtgctgagaacctaaaactgctccaaatattatagtctattaaaaaaattcaacaccaaatttgaattgttgaagccagagtatggacttaagtagtttgtgtttatgacatatgttatctatatattccttatacaaacatacatgccactttctcatgtgaaatagtatatcttcctcctcttcatcaccttctcaaccacacttggatctgacctggctttcctccttgcttgagtaatataacttggcaaatttgacattctggtacttctgaagctaaatcataagaagactttcaagtgtctggctagaccaaccagaatgtttgctcctggaacacggtaatgtaaggagaaactgctacagaggtattatgtagcctctctaatacacaggcccaaccaaacccagacttctggccatcttgctcaagtcatagactgaataaaagtacctcagaccctcaacatcagccaaactaccagctgaataccaccagatgaacattggttgacatcacatatgaaaaacttgcccagccaaactctgccggaattcctggcctataaatttgtgagaaatcataacataaattttgttataagtcactaagttagactaattttttataggaaaataagtaacctgtaacatattttgttcagtaatctttcctctgggcaaacttctctttgtttacccacccagagacagagaagtctccagttctactttaatatataaacatttcaagaaaaggagcctctgtggcgtatcttggaggtaatcaatatgaattttatctgagtattaacaaaaaatgaaaagagctttgttgaaaatgcttctgcttcatagtgatgtcttagggattggaaccttcctgttacaaaaataaacaaacaaaaaatccccaactctgtaagctattttgtgtctaagcatggaggtatactcccttgattgttggccaaaatatccctaagattcgctccaccaaaatatactctcggtttctgactagacaattatatatgtctttgagttatttttgacatgtatcaggaggtttcactgagatacttaaaataaaaggtgctgttgaaacaaatacttgacactcctagaacatttaagcatttagctcattatccttaattccttctaaaagtgctaagtgtttcttataaaataatatttttggtctgattttgatttacacactgataattatgtcttccttaatcagcatgtgttctggtttttaatttcatggtatattcatttaaagatttctgttaggtgacagtctattttctttcaagtggcagaggactacaaatttggatttttcttatttactttattagttggattccaaagtttaatgatatccaaagttttagaattgattagtttattcactttccaattatagagccatctgtctttgtctggtgttacatgaaactatgatttttttaatccccaaaatggttgttttctttatacctctcaaatccacccattttgtctttaataattatggcaccagatagttaacaacatccacagaattggaattcctacaccaaagatgatgtttgtataaaaatgtccccatatgtgaaattttgaatctcttataatgatattcttttgaattgtgtgtcagaagaaacaaaattccagcagaaggtgttcagcttttttaaaaattaacatgcaaagcaactattgggtagcactattatctcttcaaacctctttaaataatactacagaaagcagagaaagggaacctattttctaaaatggacaatagttattgatgtattaaaaaattatcccaaatctagtgacttaaaataacacatatttatctcagaatttcagtgaatcaggcatctgaccacagcttagttagatcttttactcagggatctcacaagtctgtaatgaagaggttggccagactgtgttctcatctggaggctcaactgagattgaatccatttccaagctcattcagtcttagaacaattcattttcttgcaactttatgtctgacagtcctggcttattactgtccgttggctgggagcctctcactgtgttctctgccaactggaaaaataactatccttgctggattcataaggacttttataaactttcatattttaccagtaacactcctaacactccactgaaggatccagtagtgttaattatactgttattttgttctttagtcaatattctaaataaaaaacaatattttttgttccacttttaaggcttgctactttataacaacttgcccaaggttaattaaaaattttgtttggggagtacaagctaatttttttgaaaaacgtatttgcataacttttctatttctggagtaaattaatacatttaactatgtgatttcctgtaatttcaggaagataactgttttgcctggcttatagaaactataagccctatatttatagatttaaataaaggaaactcaaggatttctaggaaaagtcttccagttatattttatgctactcctataactccagcagagaaagctgcttaagctttcataatgctactggcctttgttactgaattataaaataagaagcaaataactaatgggaagtttacttattctaagtaacataaaataaaatatttcagaggtaattttactttacgagttaatgcaaccttcctgatcaagataataaatggaaaaattgtacctgttaaatagctggattataaaactatattcactcactctctctctcattttatctacatatagaaataaaattaacatgatattctagctgattcaaattttgtttttctcttcactttaacatctaataaatttagttatcttattcacataaggatttttttttctttttttccttattgtgataatacttaatctgagatcaacctatgctcttcacgagttaagggcacaatacagtatttaccataggcataatgttgtatacctaatctctggaacttattcaccttgcataaccgaaacaatgaacagtgagtctccatttccttctccccctacctcctaacaactaccaatctaccctctgtgtctgagtttgactaatttaaataactgaaatatcatgcaatatttgtcattctgagactggctaattttgcttagcataatgttcacacgttttgtccatgttgttacatattatggaatgtccaatttaaggctgaataatattccattgtaggtatatgacacattttacttattcattcatgtattaatcgacatttaggttgttgattccccttcttggttattgtgaatagtgctgcagtgacagagtgctaacatctctttgagaccgtgatttcaattcttctgaacaaatacccagaagtgagattgctggatcatatgatagttgcatgtttaatgttctgaataacctccatactattttccatagttgctgcaccattttacatttgcaacaacattatacaagcattccagtttctccacacccttggcaacatttatatcattatagtcttattttataatagccatcctaacccatgtgcagtgatacttcattatggttttgatttgcttttccctgatgaattgtgatgtttaaaatcttttcatgtgtctgttgaccttctgtatgtcttttttgaagaaatgtctatggaatccctttgtgcattttttaattgggttgcttttctattgagttttgtgatttctttgtatggtttaaatattaaccctttatcaggtctgtggcttgcaaatatttattcctattccttaggctgcctttaaactctgttgtttcctttgctgtgcagaagctttttaggttgatgtagtctctcttcctatttttgcatttgtttcctgtgctttttgtgtcatatccaagaaatcattgtaacaagcactttcaagaaggtttccctctgttttgttctaaaagttttacagtttctggtcttaggcatttgtctttcatctgtactgagttgattttgtgtatagtgtaagaaaaggatccaaattcatctttttgcatataaatatagttttcataacaccatttgttgaaaaaccccaatgctttcctcattgtgtagtattggtgcccttgtcaaagatcggttgactgtacatgtatgggcttatttctggactctccactctatttcattggtgaatatgtctatcttatgccactaccaaattgacttaattgctgtaatttgtgttatattttgaaatcagaaaatgtaatgcctctggctttgttgttcttgctcaagattactttggctatttggaatcttttgtaggtccctatgatttcttggattttttttctatttctgtaaaaatgccactgggattttgatgaggatcacatgaaatcactagattgctttgggtattatggccattttaacaacactacatcttctaatacatgaacacaagatgtctttccatttatgtgtcttctttaatatcttttatcaaggttttctattagcagtacggaagacttttatctccttcattaaatttattcctaagtactttactcattttcataccatcgtaaatgggatgtttcttaattattttcagatagttatttgttaatatagacaaatatcagtgatatgtgaatattaattttccatcttgtaacatcactgaatttatgtattagttttaaaaatgtttggttgttttgagtcttcagattttctacatatatgatcatgccatctgcaaaaagagatatttatccctgtctgatatggatgccttttatttcttttgtttatctgctctgactagaacttatactactatgtggaatgaaattgacaagagtgaacatccttgtctagtacctgttcttaaaggaaaaggttcagtttttcatcattgagtatattagctttggacttttcatagatggttcttattatgttgaggtaaattccttccatatatactttcttgagagattttgtcatgaaagaatgttgaattctgtcaaatgctttttccgtataggttgaggcgatcatgtattttttatccttcagtccgtgaatgtgatgtaccacattgattgatttgcatatactgaaccattcttacattccagaggtaattcctgctggttcgtgatgtatgatccttttagtgtgctattgaacttggttttacagtattttgtctttttttccctttcatgaagattggggtctcactatgttgcccaggcaggacttgaactcctgagctcatgctgtcctccttcctctgcctcccaaaatgctggggttacaggcatgagccactgcacccaggagtttactaatattttgttgaggatttttgtatctaggttcatcacggatattgacctatagttattttttttgtagtgccttcatttagctttggtataaggttaatgttggccttattaaatgagttagaaagtattttcttcaatgttttggaagagctggagaatgactagtgttaattctttaaatgtttgatagaattcactagaaaaaccatctggtcctgggtatttctttgttgtgaagattttgattgcttattaaatctccttatctgttttagtatgttcaaaaacctattttctgctttatgattcagctatagtacataggtgatatgtgtctaggaatttatgtattccttctagtttttccactttgttggcatctaattgttcatattagtccctttttatttttatgatgtcagttataatgttttttctttcacttctggttttatttatttgagttttccctttatttgttagtttcattaagggattaccatttttgttattttttaaaaatgtcaaactctagtaattattttcctgttgattttttcttctacttatgactgctctaatttttgtcattttctttttctgctcagttatgacatagttgttttttctttttctagttccttcgggtatactaagttaagttgttttggggggattcttcttctgttttataataggtatttgtcactataaactttcctcttggtaatgcttttgatgcaacccataagttgtgagatgttctgttttcccttttgtctcaaaatattttaaattttccttttaatttcttttttgacccattggttgttcactgtattgtttaatttgcacatatttatacattgttctagttatcttttgttattgatttctagtttccttcctttaacattgaaaaagacattaggcatgatttcaatctttttaaatttaaaatttcttttttgatgtgacatatgatctatactcaaagatgttctgtgtgtgcttgagaagaagatgtattcagttgctgttgggtggcttgttcttcgtacatctgttaaatacacttgttctacagtgttactcaaagctgtttacttactgattttctatctggatttctatccatcattgaaagtgaggtattgaagcctcctactagtaatgtgctgctgcatattattcccttaagttatgtcaatgtttgtttcacatatttaggtgctctgatgatgggtgcatatatatttatcattgttatacatcttcctgatgaactgaccctgtctatcattacacaatgaccttctttgtctcctgtaacagtatttggcttaattttattttattttatttttttttgacagagtctcgctctgtcgcccaggctggagtgcagtggctcgatctccactcactgcaagctccgcctcccgggttcatgccattctcctgcctcagcctccggagtagctgggactacaggcgcccgccaccacgcccagctaatttctttttgtattttttttagtaaagacggggtttcaccgtgttagccaggctggtcgcggtctcctgacctcatgatccgcccgcctgggcctcccaaagtgctgggattacaggcgtgagccaccgcgcccggccggcttaatgtttttattgtctgatgtaagtatgtgtcgctgtagaagaggagaattacagatacaaggaaatcagcagatgaatttggagttacgctgccagaaaccaagaaactaacggaaggtacgagaaaagcctgaaagagatctttccctagcaccttctgaggcagtatgaccctgacaatgccgtgatattgtgattctagtcttcagaattgtcagacaattgatgactattgtttaagccatgcatcttatgttacatggttatggaagccttagcaaactaacacagacattaaaatcaccatgtgtaactgtggtcctttaaaaaataactgcaataaaatatagagtaaaagtaaaaaggtcagtgaaggaaaaggtatagagcttaacttactaagatgaaggggcaatggaaacgcactagcagatatcacacttgtagatattaccagcccctctgccctacaagtaaactctcaagcataatagagactgaacttgtttccgtgatttccctaagccaacatgcggaatgcagtcttctcagactggtacttaaaatccaccagctaaccaacttaccaaatcaaatatattcccacactattactttattcatcgctctcttcttcaaattttgttttgtcttttcttactgacaacagccctccataagaaatgaagcatatgtatgtatagatgtgaaatgtctctcagttattcattgaccttagacaaaaagatatagatgattactgatagttgaattccttaaaaattgttttaaatgaggttgaatttttttctagaatttaaaatacctgaagtattccattatatggttcaattttgaggaaataatctgtgaccaggtaatagtatgagctaaagtacagaaggtaaagagattatttatcaggtatataaacggaggaaggaaatcagatttcttaatactgaagagttactggagcacacagaatgagaacaaagaaactatatttattaatgttaaagagtaattataaaatttggtagagataatgcagctagagtagggataaatcttacccaactgctatattctatagaactgagagactcctgttgctaggcaattaatctaaaacttaaatgagagacaattgaaggagagaatttatgattctcttcatcatgtgaggcctcaaataaaaatattcacaaagatgagtgtataaacaatcccagtccacgaatagggctacaattagataagatctgacaattggagctgacaattcatctgttggtaagtcattcaaaagtttagctctagaagagagaagcaccagtacttatgcatgcatgaatacacacagatacacatacacgcacaatgtaattctttaccaagtgttcagatattcaggaggatttacactcaattatttggtagtctacttacttgcttcagaatctttaacatgtttttaaggatttttttaaaattttactcatagtttataaacagtgaattaggctataaatgagagcgagagggatgtggtaattagggtacagagaatgatgaattcaatgagtgtggagacaaaaaacccaaactttgtaaagggtaatgtatgaccaactactttgaagtctctactattatagcactataccacattattaatgaaaatattatattttctcaggaggtgtagtctctggagtcattgtataagataatgtaataagtgcaaaggcagtctggctcaaatatttttttcaatttgtttcctactgcttgcaagataagttcttataaacaaattctgaaagatgtatactggttaagttcactctcaatggggctacattaatgaaaaataatccttttccatcacaacaaaaatccacactccataaaaattaacaaatatatatcaagagagatatggagagaaaatcagcgtaacaaaattttactcacaatgtatagatgttgtcctcaaagatttcttctactgatgtggctttcttcttgtggcctcttggcattttgtgaagtaaacctcccttttatatcacttgattactttacccaagcaatcaagccactcttttcactttagtgagaaggataacatattcagcctgcaaaaaatccgctgctacatacgtacaatgacaaaccaaatactaaatatctaatcctatattaaacaaacatgaaatgaaaaatttttggttttataacttaaaatcactgatacgcaataacaatagtaactcataaaaatgaagacaaggttgattttcacttagggtcctatgcattaatgaggaaacttagaaaaacagctagttaagaaaaaatgtgaacaaaataaaaattattaagagcataggagtgtttaaaatatctgtccatgatttcatcatttaagggtgaaatgtcaggccatttgatcttaattttatgtttcccctttttaagcacccctaaatatattctgcgatttattattccagaagtgttggcagtgagctgtaggagtggccaaagcagacaaaggattaatctagattcacttgaggattgtggtcaacagtggttgaactgaagaagtccagagctaggctatggggatggaaggcacaggaggggaatttggaaagagggaaaaaagaaaagaaagtgattttaatcctctatgaatttgatgtgtaagtttcaattaagaatacaagttgtggttaactaatatatccaaattaggatggtcaaggatggtaacaccatagaggtgatggccataggtcaacagcaaaagcttattgaagatgagatgtacaggtaacaacaaacaaacaaacaaacaaacaaacaaaaaactgggtgctgtatgggttttccatgcttggcaaacacagtaaatattattggcataattggataagatgattggcagagaagaaagtagtatcagacacccatttatttgtggtttgtgcaggactgatttgggaagttggtgtaatagtaaggaagaaaagtagataataatataatgagatggctgccagttaagtggtttgtaagggcctttggcaatcaaagcaaattatggccaaacatctggtttatagggaatatgagaatgctgagaatagaaaactccctctctgctgggcttcccatcgttgagatataagttttgtaaacttcagtagcaataatgagctctccataaagagatacgagtggagaagagattattgtggcttttcatgaaagaaaggttctgtaagtgacaggaaaatgattccagagaaaagaggtcaaacatcaagataaaacataattaagtagaaaagaatccaggtatagaagatgacaggtgctgaaactagcatttttgatttttgtattacctaccattgaaagtggtatttaatcggtgtgttttagattcctcatagcagatttcactttctcctgtgatttttttcaattaagccagtagttcttaatctcattactttgataatctcatcattaatagcctgataatcactgtgaatactctcactagctaaataaaactaggcattttctatgtaaaatatggaatggaattttacaaattcctaaagtgtatctttgccccaaacactctgcctgaatttatgctacgtatcattaacttattttggcctgtatcattcatttttgtttctaagtatgcagcttagtgtctacatattacatggtttaattaatgtgttattgaagagcaaagcaacaaatcagtgttgccagccatactagatttctcatttgcacaaatacgtggtaataaatttgtactattaggtaaaactttttattgtatttttatataagctatgtaaatgttttttcatatatgacataaatacttttggaggtcaatctcaggagctggtgactttatcgtcttaaaactgcaagggacattgatgcctttgttccagcataatattaccttccccaaagccttcctccccctttttggggttcattaatttccttttcatttctgaaggcagtttgttttgtcttcagcattttcacatctctgaccgttactttcctggcttgttttatttccttttcatttttcatagccaaaggctttgaaaagagttatttttattaagggtataactaaatatatacatctttgagtaatatctatctatggacacatggtactacctcatttaattccactatttttttattgtgttattccacaaaggtatccactacagtaaatactactatttttgaagagcaactgatgctttgtaatttgacaggaagaagtgaagataggacaagtaatgatttgttgcatggaagtatatattaagaaagatgaaaaaagatatgaaagtatttcatatatatatatatatctccagagtaatgtaactaaataatgtatcacttgaaactgaaaggaagaatattgatatttattccaattcaatatgtataaatcaagattcccttatcaaaacaagatatacgttcagcttttaagagcctttccttttaaatatttgtgaaaatgtgcacacatatacatatattttgataacagcataatgaatccatgtgttctttatctgggttcgggatttatcaactggcaggcaattgtcattttttagtatacagtctgagtttgcgtcaccaatgttgaaaagccaatccaatgtagtattatatattgagtcatgtgttgagccaaacactaatccattttcacccatatattcctgtttcttcttcaccctggcctattcataacaccacctgtgtgtcttcccttctttttattttgtcttttaatttggctgctctgatagattgactgtcagaaaacagaccactaagggtcagcattgcataaaatcaacccaagggagaaagacagacgaatcttgcctcctgccttcccctcttttgctctcactcatagctccatcatggtggctccataaaggctgcgggtgaggccctgctgcatatgaggatcacacacctgctgctctcactgaggatatttctcttccttttttgatgagcccatattgggcacaagaccacagccccccagaagtggtgataaccctgagggtaacttgcactggtagtggtatgaatcttctaagctggctctcctgtagcttgtaatttgggaaaaagagacatattgtccacatcagaagcttttgatttccaaacacctcccagtgttcacctacaaagaccaacatgctctcctggaagatcaccctattgtctggaatgactgctgctatcatagttttgtggaaagggatccagaatccctggttgctattagcaactgttttgggggttttcaaggaacgctacagataaattacattgattatgaaatgacacccaaaaggccttctgccacatctgagcatctggtataaaaagctgggtagtcaggagacaaaattcccaaccatgaaacgtggattaacagaagatatagtaagagaattaaagtttcaagaatgtgataattccactctgatgcaaagtggctatgagggctggagggagaacccacgcattttttcttgaactggcaatagtggtagactattcattatttggaaagtaatacctcccttgggcaggaggaaataatagttgttgccaacaaattaaatgttgtttaatagtgccataggacttaatgtgattttaactgtacttgagatctggaatgaagaaaaccaagttacagcaggtgacctatgtgttcttatataactttggcaaatggaaataaatagctataatttctacatatctgatgatggtgtagaacttgcagtaaaggataaatatggtagattattatcctataccattattggttcaacctgtaatattggttttaattatagagttatacagttccaaggtactgaatttatatcatttgcattgctgttggtacacgagttaggtcataggtttggtatgcagaatgatggtaaagattgttcttgtggtcatgaaacatgcacgatgtcttcaagaatataaagggcaacaaggtgaaacatcgtctccacaaaaaataaaaaattatccagatgtggtggtcccagcaactcaggaggctgagatgggcagatccattgagccactgagccaggaaaattgaggctggcaatgagctgtgattgtgccactgtattccagcctgagacagagtgagagcctgtcttaaaaaaaaaatatatatatatatcaaagacaagtcatctattcagacacagaaattattctatattggtcagccttttatctaagcactatttgtatactgaaatccagagaacatcattgcagagaagtgctgtggcaatggtgtggttgaagaaggagagaagtgtgactgtggatccttacgattgtgtgcaaaatatccatgttgtttggcaaactacactctgaaatctggggctgcttgtgcttttgggctttgatgcaaagcctgctaattcatgctgtcaggcaatatgtgcagagaagagaacaatgaatgcgttatctcatagtgtttcaatagaaattcacatattgtccagcagatatgaatgtgcacaacaggatccattgcatgggcagtgtctattgctatgaaaagggatgtattaactacgaacagtgtaggcaaatttttggcaaagaagcaaacagtgcaaatcagagttgctacagagaaattaatacctgtggttaccattttggtcactgtggtatctgaggctggacatgtaagatataatatctcagatatcttttgtgggagagttcaatgtgagaatgtgaaagaaattacccatttgagagatcacactactgagcactgaactcacatcagtggtgttaccagctacagtactgactttcatttggggatgacaataactgatattggtgtagtgaaaaatagcacagagtatggtccaaaacaagcgtacattgacaggaagtgtgttcattatcattttggaaaagtacttcttcttctaagacccgcaatatgagaggaatctgcaaccataaacattagtgccactgcaaccaaaggtggaaaatacttattgcctgatacagggcactggaggtagtgttgatagtgacctataccctgcccaccccaaaaagatgaaagagttgttcaaaaggattttcttgatagtaattttttaattcctttttctcttttgttttactgtttgttaattttgctttcagtgatacacacaacaaaagaaaaagaaagaaagaaacaaagaaagaaagaaaggaaagaaagaaaggaaagaaagaaagaaaagaaagaaagaaagagagaaaaacatcatctaagaaagaagtgcaaattgttcaaacttcacctgagatagaaaagcaaactgttcaaacttcacctaataaagaaatgcaaaatgttcaactttcaattatgaacaaagagcaaaatctttaaactttatttcagaaaaaaatagtaggggattcctggagaagctgcagtgtggggatgctctagaccgagtactgcccccagtgtctttccacctcctcctgcagcagcggcagcagcagcagcagttagcagtagcaacttgaggctgcaccccgggctgccactccaagagcggaggcagtgagagtacgcgtgtgcctcgcgccagtccacgctaggagagcactgggaccgagacccggcaccacctcccggtccgccctccagaactttgttgaggaggagccaagatggccgaataggaacagctccggtctacagctcccagcgtgagcgacgcaaaagacgggtgatttctgcatttccatctgaggtaccgggttcatctcactagggagtgccagacagtgggcgcaggtcagtgggtgcacgcaccctgcgcgagccgaagcagggtgaggcattgcctcactcgggaagcgcaagggatcagggagttccctttcctagtcaaagaaaggggtgacggacagcacctggaaaatcgggtcactcccacccgaatactgcgcttttccgacaggcttaaaaaacggcgcaccacgagattatatcccgcacctggctcagagggtcctaccccacggagtctcgctgattgcaagcacagcagtctgagatcaaactgcaaggcggcagcgaggctgggggaggggcgccctccattgcccaggcttgcttaggtaaacaaagcagccaggaagcttgaactgggtggagcccaccacagctcaaggaggcctgcctgcctctgtaagctccacctctgggggcagggcacagacaaacaaaaagacagcagtaacctctgcagacttaaatgtccctgtctgatagctttgaagagagcagtggttctcccagtacgcagctggagatctgagaacgggcagactgcctcctcaagtgggtccctgacccctgacccccgagcagcctaactgggagacaccccccagcaggggcacactgacacctcacacagcagggtactccatcagacctgcagctgagggtcctgtctgttagaaggaaaactaacagaaaggacatccacaccaaaaacccatctgtacatcaccatgatcaaagaccaaaagtagataaaaccacaaagatggggaaaaaacagaacagaaaaactggaaactctaaaaagcagagtgcctctcctcctccaaaggaacgcagttcctccccagcaatggaacaaagctggacggagaacgactttgacgagctgagaaaagaaggcttcagacgatcaaattactctgagctacgggaggacattcaaaccaaaggcaaagaagttgaaaactttgaaaaaaatttagaagaatgtataactagaataaccaatacagagaagtgcttaaaggaaccgatggagctgaaaaccaaggctcgagaactacgtgaaaaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgacggggagaatggaaccaagttggaaaacactcggcaggatatcatccaggagaacttccccaatctagtaaggcaggccaacgttcagattcaggaaatagagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagggctcctgaaggaagcactaaacatggaaaggaacaaccggtaccagccgctgccaaatcatgccaaaatgtaaagaccatcgagactaggaagaaactgcatcaactaatgagcaaaagaaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctatcaaacaaaaaaaggcaggggttgcaaccctagtctctgataaaacagactaaaccaataaagatcaaaagagacaaagaaggccattacataatggtaaagggatcaattcaacaagaagagctaactatcctaaatatatatgcacccaatacaggagcacccacattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctatagaactctccaccccaaatcaacagaatatacatttttttcagcaccacaccccacctattccaaaattgaccacatactgggaagtaaagctctcctcagcaaatgtaaaagaacagaaattataacaaactatctctcagaccacagtgcaatcaaactagaactcaggattcagaatctcactcaaaactgctcaactacatggaaactgaacaacctgctcctgaatgactactgggtacataacgaaatgaaggcagaaataaagatgttctttgaaaccaacaagaacaaagacacaacataccagaatctctgggacgcattcaaaggagtgtgtagagggaaatttatagcactaaatgcccacaagagaaagcaggaaagatccaaaattgacatcctaacatcacaattaaaagaactagaaaagcaagagcaaacacactcaaaaggtagcagaaggcaagaaataactaaaatcagagcagaactgaaggaaatagagacacgaaaaacccttcaaaaaattaatgaatccaggagctgatgttttgaaagatcaacaaaacagatagaccactagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaactgtggcaataatcaatagcttaccaaccaaaaagagtccaggaccagatggattcacagctgaattctaccagaggtacaaggaggaactggtaccattccctctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacagcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacaacgcttcatgctaaaaactctcaataaatcaggtattgatgggacgtatttcaaaataataagagctatctatgacaaacccacagccaatatcatactgaatggacaaaactggaagcattccctttgaaaaccggcacaagacagggataccctctctcaccactcctattcaacatagtgttggaagttctggccagggcaattaggcaggagaaggaaataaagtgtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttctacaccaactacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgccaagtcaatcctaagccaaaaggacaaagctggaggcatcacattacctgacttcacactacactacaaggctacagtaaccaaaacagcatggtactggtaccaaaacagagatatagatcaatggaacagaacagagccctcagaaataatgccgcatatctacaactatcggatctttgacaaacctgagaaaaacaagcaatggggaaaggattccctatttaataaatggtgctgggaaacctggctagccatatgtagaaagctgaaactggatcccttccttacaccttatacaaaaatcaattcaagatggattaaagacttaaacgttagacctaaaaccataaaaactctagaagaaaacctaggcattaccattcaggacgtagctatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcagcctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagacctagaaataccatttgacccagccatcccattactgggtatatacccaaaggactataaatcatgctgctataaagatacatgcacacatatgtttattgcagcactattcacaatagaaagacttggaaccaacccaaatgtccaacaatgatagactggattaagaaaatgtggcacatatacaccatggaatactatgcagccataaaaaatgaagagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcgtggcacatgtatacatatgtaactaacctgcacaatttgcacatgtaccctaaaacttaaagtataataataaaagaaaaaaaaaaagaaaaaaatagtaaaaatttactatttcagaaaataaacccaattcctaatgaaatttttcgtctgttaatttttaatgacctggcagtagaaatgttattgtgtatgtcagagatcattgaaagaaaatcccagagatctattatatttaataatcacaaatagtagccattaaatgaaaaagttagtactagaatattaatacttttcattattttaagtaattttagtggtttatttttcatgaaattagtcacatgtttcctgagcaaaggccgggctcatggatgatatatgtgcattttaattttaatgtgctgtctctcaatttcaaaactccttcccttttccaatctgctttgtcacaagaaggatgggtgcctatacaataacagcttttctttgccagtcctctctctattagtgtcttccaatggggcggctagaggcagactagaaacctgagataaccatttcatagctgttcatgtcagcattggctcagtaaaagcttttaccttggcagcagcagtagttctcagtctgtacatgatttttattgttaaatcaaaaacttcagacaaataaaatttagcagagtttacttgaagaaagaatcattcatgaattagtagcactcagaaccaggagagattcagagacctccactaggcaacatggccattcagtatttgtagacaaaaatagtaactggtgtatagaagcacattgattgtttacagctgggcattggccttatttgggcatgatgtcataaggcatatgccttatgtggacatggtctgatcagctggcaccctgtgattaactgaagctcagctgccgtgattggctaggactcagccatttgttgcaggaatatacttttaagttaggtagcagttttttttttttaaatacaacattaggttgaactctgttatgaaggaattcaaagtatggagggagttttaggccatatttattttaatttaaaatgtccccatttggtcggcttctcaatttggaaagattgaccaaaaccttgggcactgacatcattctgtcaccatcacaatgatcttgtttggtctcagtatggaatttataattcacaattgggttagttgaatgtttcttctgttctttttaggttttcactattcaaactgtagtaagatcacttggcatatgacagatggctgcataagaacatttaagactcttgagagaatctggtgcaccagagaaaccattatgatggctatcaggaggataatactaagaaaatgaaatacactctaacaggagccccaaataagcaaactgatcaaaatcaaatatataaaatatgaaccacaagagaaatctatttgttttagccattcagcttgtttgttgatttcttgcagctgaatttcttccataccagatgtatttatccaagggcatcagaagtgttagctatcacacatgctcccccttgttaggccatcaatagatagtccaaagcaatcatgttatctaaggacaacattagtaagaaagtttcaagaaatttccttgggcaactgtaacctttgcagtagagtcagctatatatggtacctaatatttgagataggtttctataatcataacttaaatgacattaatgcgaagccagggaaaatcacccttcaaaaagatgcctatttggaaggatttatgtctgctagcaaattcctctttattctatagtgcaaattaagaagtgtggcccaatgatcagttttcaattggttatagagtgacagtggtagcattaaaatcactcatctacattggtccttcattagccacttactgaaacatagggttgccatgcacatggttaaatgatgacaatattgttaaatccttcacagataaatatacatcctggaaaggcacaacaaacagctctctgtgggatgccttgtgtgtgagcagtcatcagtagggaaacactagcagcatttatgccaggctccattactgaatcactgaatgctttgatgcttccaaaaattaaaggaataggttacacatttgtgtacaaattgttgaattatttttcctttcgtcttcttattcaacttatggcagagtttaactgcaaaaccatcactttagttttgtctattgttacatttaaacaagaaaactgaatacataagtctagaaagtatcagaaatcatatttgaaataccagttacagagtgaaccagaagctaagattatataaggacttacgtttcacatgacatatccaaaattcagttaagttccctgagtatcgggggaaattcagccagatatcggccgaaattcagccctgatacttcacgtacgttcttttctattttccctaagtgtcagccggtctgagatataaagggacagagtacaaaagagagaaattttaaagctgggtgtccgggggaagacatcacatgacggcaggttccatgatggcccctgagccgcaaaaccagcaagtttttattagtgattttcaaaaggggagggagtgtacaaatagggtgtgggtcacagagatcacgtgtttcacaaggtaatagaatatcacaaggcaaattgaggcagggtgagatcacaggaccacaggactggggcaaaattaaaattgctaatgaagtttcaggcacacattgtcattgataacatcttatcaggaggcagggtttcagagcagacaaccagtctgaccaaaatttattaggtgggaatttcctcatcctaataagcctgggagtgctatgggagactggggcttatttcatccctacagctttgaccataaaagatggctgccctccgaagcggccattttagagacctaccctcagggacgcattctctttctcagggatgttccttgctgagaaaaagaattcagtgatatttctcccatttgcttttgaaagaagagaaatatggctgtgttctgcctggctcaccggcggtcagagttagaggttatctctcttgttccctgaacattgctgttatcctgttcttttttcaaggtgcccacatattgttcaaacacatgtgctctacaagcaatttgtgcagttaatgcaatcatcacagggtcctgaggtggcatacatcctcctcagcttatgaagaggacaggattaagaaattagagtaaagacaggcataggaaatcacaagggtattgactggggaagtgataagtgtccatgaaatcttcacaatttatgttcagagattgcaataaagacaggcataagaaattataaaagtattaattttggggaactaataaatgttcatgaaatcttcacaatttatgttcttctgccatggcttcagctggtccctccattcagggtccctgacttcccgcaacacctgaggatgctatcaaatatgacatcttaattactgcattatcttgtcatgtatagaaagaaaagaaacacagagaaaaaagtcaggaggacaaaagtttcatgcaggtaacttcacctgtgatcttgggaaggttgtctacacctaggatgtcatctgcttctctgaagaaacctccctggccagtttgaccatgaggtctccaatgactgtacaatcccaggagtctggaatggctctcttaagttgagacatgaatccaagaatcaaggcaccgaagttgtacttccaaggggttccaagggcagtctttttctggtgttcattccaaaagactcaacatccagactctagatcattaatggtgtagcagatatctgctggtggttcacaaagggcttcttttcggtggaaaaaatatactttggcataatccattaaggtcttgcaatatcgagtcatttcagagttcatgagtgtgagatacatgaagtccaattattaggggcatggtccttctagtaattatttcataagcggtcagtctgtactttctagtggatcatcaatcagtagtaactttgatcaaagcaacccattcgattcagttagctttgcttaatggctttgtgtttgcaattccttatttgacacttttataatttttctagtgaaatgaataccttcattgctgaagatttctccaagaatgccccataaacaaaacacattttctaataatttttttttttttgcttatgttatagattcagccttctcgcatgggaaagattttatacaaacagaaaagagtcatcaaagttggcaattgagtaaaatccctctgtaaatattcaagtgatccagtaagtggcaaaaatgtatcaactgaggtcattttcttactagaattatgggtttgacaaccccaacaatggttataaaccacttcagcagttttagaatagtcaccccatcatttcttttcatgatttgtatcatctcatctattccataatgagtcagagtgttgtctttaataatgaaaactttaaaaagtcaggaaagatcaggcagctatcaaagcctccataagtctccacttaacattagatctacatatttttaaatactagatttttttccctccaagtaaggcatgtagcactgtttattaaatagttattataggtaatttgacttggatttatcttatgaaattcattcaaattgcatataataacaatttcagtactgactgacttagcataaaaatctgactacgcatttccttggtatttaattaactcttattctacttgatttttggttagcagttttatgaatcagtcagtctcttcattagagtttttgggaatacttacctggtacaatagtatgatcagatttctaagacaggcatgtaatttctggaatacataataacacatctacacaaatataattcaaagaaggtttggacttacttatttggcaatgctttcacataatttaatatatcaaataagccaaattaacttaatatctctcttttcacaaagatagatacctgtttgatttttccaatagcacccatgaaaaatctcaaggttaatttgagattaaaaaaaaagacttaatttaaatttggtttctgaaagtatgtcaaaaatatgaaggatgtgaaacactggatcaaaataggatcacaggctactgtgtatgatcattgttaatttaatcaaagtaataatttaaagacttccaaggcaaatacagaaagtttgttgtagaaaaattttagttctttcaataaagaaggcagttttcttaagccaacaaaaacctagtaaacactgaagtgcaagaagttatcttagtaaaacgcagaatcattgttttctatcgcctaggccatttaactaaaagataaagaaggctgggcatggttgctcacgcctgtaatgccagtactttgggaagcccaggcagccggatcatgcagtcaagagattgagatcatcctggccaacatggtgaaaccctgtctctactaaaaatacaaaaattagctgggtgtggtggtgcatgcctgtagtctcagctactcgggagggtgaggtaggagaatcgtttgaacccaggaggcagaggttgcagtgagagatcacaccactgcactccagcctggcgacaaagcgagattccatcaaaaaaaaaaaaaaaaaaaaaaaaagagagataaagaaaatcccttcacggtttcttttaagaacagaccaaaattccaagaaaactgttgtttaacacaaggctcaaaattctagtttcatatcagtgtacttttggtgttaatactccatttttagaaaaacttataaataattcctttctaagtttatctagcttaatcacacataaaattcctttcacaagattcatcttccacaaaccttctgacttccttatccattcagtttttatcatatactttccctcttctcattttagaactagtcattctttagaaaaaaaattactttcttcttcccttaacaaaacatcctcataccttatagtttttgcatataaagacacatcttaccttccttgtatactcgcatagagagttatttcccttattatttctaacagttttatttacacatagtattagaattcttaacccttagtgaccttagtttccagtaaacactaggaagcaaagaatttcaaaccatctttcttgctagcaatttgtagatcagcaaatctaagaattgtaatttcaagaaatatgtgtttcccaaactacaatttgtcagtgtggcacaaaacattagtatctttgataagaaactgtagatgaggcaaaacgtacctgtgttaggtttttttggctaggcatgagaatcaattgtttgtatagctatccctcagcctcaactttccattcttggtggtaagaatgttaaaaccttctgttacagggaggacatatttcatatgggaattttattttgcttacatctatttaactcaacttattaaaacaattatgcttacattattcataaagatgagacattaaatagcttgccatcatcttttcttggtgacaaattttgtaatatggtgttaagatgagctttttatcaggaaacctaggtaaaagaaattgtacatctgtattatatttaaagctgaggacactgaggatgtgcttgtcttaatcaaaccaagaaaatttttatttaccaaagattactcaagacacataaacttgaaagtttgggggacagttttcattttcctgagagaatatttagtttataaatgtgtttgtttttctttacactagttaaataaatctcttctacaatttaattctgccaatatcataagaagatagaaaaatattgatgctttttttttctttttggctgagctttgccagccagagacctctgtgccaggcaatgcccctgtccaggcctcagtcagtcccaggctcactacaggaggtgccgtgcccactcaccctgctgggctgtgcctcacttgcactccagtccagattccatgtttgctgtgggatccatattcagatcccagcaggagtggatgtgtaagcaagcgagtggggtccagctggccactccaagtgccagcactggagtgggctctgtatgaggcttgggctggaccaagcatgttgcaagtgactccctcggtggactccagcatccagacgaggggaatgtggtgatacccaaataggaatgcccgtgaccctgaagctccagagggcatgttacagtgtgctaacagctcttctagtcccaccactggcaacccaaatgggtttgttaacagctctgtcagtcccattgctccactctggcctgcagctcttgggctggcctagccccactgctacttcccacttctacttcccatgatgtagggcagcaggctacagtgctactgcctgcttcctacctgtgtttggcagggtctgaaattcttgtcccatatcaaagaagaatgaaatcatgctgacaactggagggcgaagagggcagaaaagagttttttgagcaatgaaacagctctcagtggagaggggaaaagagggtggtccccaccagaagtcaggtagtttgtctcccactgtggctgggtccagggcttttatgggctcagaatgaaggaatgtctgttgactggcttgtgagtatgcaaaaaagcctaaaacaaagacaccactgaaagatggacaatactgtgttaaaaaacaattagggaagggtagctatgtgtaaaataggtgaagagtggagatcaattggggataacatgccaaaaaggaagagacgttctcaatcgggtccatggatttatccaagacttgtagtttggctttcaggttttaaactgtctttggtttgaagatcaggtttcaccaggaactgcccctgtctgcttagaatttttctgcctcctgctgctatcaatatcacatatatgtatcattcataaacatatggacaggtacaaaaatacaaagctcgctagtttattaaagaatacctgtatccagattgttttttctttctggctgatgaattaagaccccttgcccagatggtcaaaatgcttcacttacatttgtgaaagaaagaaaaaggaaaaggaaaaaaaaatgacttagaatttttcattcatcagtttccaaatagtgcttttttattttgttctctcttttctcttcttctatgtcatcacctcgaaatttgcatttccaaagggaatagcccttaggtaagatcatgtagaaaatgtacatctcaaaggcacagagctgtaacttcaaggctaaatatcataatttgcctattgcaaaaaagaggagtataggaaaaagcccagttaagacaagatcgccaagaaaagcaccttaaacaaaggtaagacttgttatgtagatttaagccagcaaagcaccttaaacaaaggtaagacttgttatgtagatttaagccaatgtgctctccattgagagcattgctaatatttagtactcatcatattctgcttgtagagataaagacacccttacaaatagagatttccttcatagatgtatgtttttcttgcagaaagcagtcaaagtgaccagctgaaaataggtcatatgccagaaagtcttattttggagactaattggctagatgagcagttctccaacctagcgtgaatcctttagctaaaaatactgagtgaatgaagtatactgaagaaaaaacaaccatttttatggctgattacagcatagatacttctaatcttgccttatagtgagacgttgtcccatcttttgtttcctttcaagatgcagtgaaagaccaatcagctgcatttttttcccccaagaaatggttttggggcacagaaaaatcatgaaaacggctgggcaaagtggctcacgcttgtaatcccagcactttggaaggccaaggcaggtggttcatgaggttaggagatcaagaccagcctggccaagatggtgaaaccccgtttctactaaaaataaaaaaattaggcaggcacagtggcaggcaccaataatcccagctactcaggaggctgaggcaggagaattgcttgaacctgggaggcagaggttgcagtgagccgagatcccaccactgcattccagcctgggagatagactgagatatcaactcaaaaaaaaaaaaaaaaaaaaagaaagaaagaaagaaagaaagaaagaaagaaagaaaaatcatgaaaacaagaaagagctggacagagttgacagagtatttagtcagcagaggtttgagaaaagagatttcagtagactgagagtttcctatgggaaagaccaggaattaatgcttaaaatggttgttttactgaccatggattcttgggctttcaatgcaacagaaattgacatgaggccaaaagagttttcccacacaaagcttcattggagcttacacccatgcataaaggaggctgtacaagaaagagaattccccaactctccacagagagttggtagggcttttttttattagtcaaagcaaggtaactgacatcaggggtcaagtatgtatataagctggggtgggcaaagcaagtgatgggtagggtatgcaggtcagcattatcaggctgccgtagttatcttgactggccataactggtgacctgatggtctggccagtggcaacaaagctgtaaatgaactgttcagcattccttcctgaggtgggacattctccaacttttgttatctctaaggccagttcctggaattttttaattaaaaggactattagcagcgtggtatggtgtgggttttgtcatcactggaaatgcatgaaagaatgctccagtggggtgagctgaagcagagccccatctttactgtctcagttgttgcaaggggatagcttgttggttctagactggctgtaaggaataagtcccatagagctgagtgaactgacctgccagaagagctactacctctgacacaatcagtagattacacgtattcacagaatacatattattaaattagattgacttgaatatattattttatgcaaagatgagaaaaaagacgtgatctgaagatctttactattctacctattaaaaatgaagattctaattgcttctaaattcctttacaaattataagtctaagatacatatctatttacttcaaatcatcacactttgttatagaatggtctaagctatgcacatttatatgcaagcacacaaaatatgtagattcctctgaaaacagtcatactgttttacgtttccttcttagtcaaaggcaaaacacgagaaagaggtgtataatagcatcagggaaggtcttgccctagtttcttacttcttgcactgtggtcagcagatagttttatgtactgtggtgtggtcagcagagggttttctctattagtcattgagccactgctgttgcttgatttgcttctaaggcatgattccttttttttcatcttcaggtgttgagcccaagagcaattctgttctttttaagagatggggtctcacactcactatggctggagtgcagtggcacaatcagttcactgcagtcttgaactcccgaacgcaagcgacctcagcctccccagagctggggtttcagctgcacaacaccatgcccagcaatagaacatcttttaatcaacatcctgcacactaaattccaactatgatctcagagtctgcttcccccggaacccaacctgtaacagtgtgtcatttgaatggaaaataactatgaatttaaaatctcaggcttatatctactttggccagtactgtcttctttagattgtaaccaagctcaactgtagcacaattgaatcatttaagagatatcctctggtagtaattagtatcattaatcaatgtatctaggacttgtatctctgggttcttccttcaaatcagactggccaatgagactttcattttttttatttcttattttgagatggagtctcactctgtcacccaggctggagtacagtggcatgatctttggctcactgcaaactccacctccctggtccaagtgattctcatacctcagcctcccaagcagctgggattgcaggcacatgccaccaagcctggctaattttttgtgtgtgtattttttagtagagatgggtttctccatgttggccaggctggtcttgaactcccagccttaagtgatctgcctgccttggcctcccaaagttctgggattatatgtttgagccaccacaccctgcccaatgagacttttaaatgacagttgaaaggtttagctaataaaatgtaaacaaaagttttaatgtggtagtgcattgcctagcatgttcccttctctttgacacagcaagcaatcctatcgagatggaaaccagcacaaattagaggagtttttaaaattattttagaagaatttttcctattcaggttttttttttttctacaaaatcaacttatggccaatcactgctatatgtacaggtgaataagaggaaaagaagttaaagaaagaaaagtcaaatgaactttggttattttaattaccattgttagggattctgagaagcacctcttgaaggatttgaaattgcagtgaacataccagtacacaaacaaataaagccacattaaattgaaaccactcacttcaaattcagaaaggatattttgaaagaaaatattatttttttaaaaataggcatgtgtagctcttcagtaatataaagacctccttagggtcttgtacagtctgtaagaataagtacatgtttgttaaatgaaaatataaatgtttttaaacctttccggtttggagcacttctcccctacaatgcatttaaccaatccctcaaattaaacacatttttgtatttcaatattccagtgatttttaaagacactgattatatgtgaatcttaatttatccaaatgtttagtgtaactgttacctcatcaacaaagaattaactataatagcaatgagagagagagaaaagagaaactaccttctatttcactggaatattttattttacaattatggtggtggtattaacacattccattgagggaggaggtggttaggggctggataggcagacaaagagggagggtctcgggagaaggacagagaaaggcaatgttcacaggaacaacctcaacacagcacctacactgcctctgcagctaatgggaagaaacgtggttaagaatttccccttgtgccaggatgttgcccaaagggactgttccaacttaggcacaggcacaataaatcaacctaaatgtacttaacttaacccagctcattataatgtcattaacatggcattagtattgttgtgttagccctccctcggttttgcttaggtattcatgggtaataacaaacatgaagtcacaaacccacagaaaacatcctgacttctgccatatcaaaaacacagaactcagccccatttctggcaacttgctttcaggccccctctttttgctaagagctttcaatttgcttaataaatcctattctactcattctctggtgtccatgtcccttattcttattggttgtttgacaagaacttggacctaactaagctagggactaagcaaactgcaaccccatccaatattatcatcttttatgtaacactcattctttctttgaaggatcttgggtctatgagggtctgtgactaaaacagaattgatgctatgtgactttctatgctgtcataaaagcttccttctgggatactcacatttttatctctattaaaaaaatttaatagagagccttcagatgacctcagtctggtcttcaagctgcccaagctgatactgagtgagctgtctctcctcaggcctgcccaaatgggaggtttgacagcataacaggcaatgcaggaaagggcacctgagaaagagaaaggagaaatgtgaggggagccctgcaattgcccccacatactgcctgagggaatagctcaccaacagcccatataagaagagtccaactggagcttgacaatctccttgacttggaggagatgaagttgtgaatttgcagaggccaagggaactagagattgcaggaaacagtattgatcatttaaaatcactctagtaattaccaatgtaatttcattcttgtccaggggcccttgcatttgacattccttctgccctgtactctcttctagataaccatctggctgccttacaaggcattacattatctgtttctaactactttattaagatatcacttgctgtcaatctgaatccacttgtgttttttgcccttagaatttatcacaaataccatagacatcaaatgtccctgaaaattatgcaagcagattcagaaaagtccagtggagaaaaatagaatctaattatctgtcatttaaatatcttaagaaatgcaaaaacaaaaatgaaacaaagcattaaagtatcaaccacaaatttaatgttgtttgcagacgtggtagaggatacatttctaaaggtgttacttcctcatacctttaaattaggattatggttccaattccttcaagttataaagttcttattatcagagctatatataaaactaaatggttttcataagttttgtggacaaaaagttggtcttgattctagacctgtctgtgctccaattgctagatttttcagccatctgattaagaaaacaaaaccaaagaaatcatttgggcagggaaacatccaaatttttagatagtataatatatttcttaggggtaaatacatttattgccaagaaattctagattgaaatattataacaaatcaatcccataatttctgttaagaaataatttagcacttttgacattttgagtacattgtaacatttgaagtaattggcattttaaattattttctgattacacttgaggttataatcacaagtgtgtagttatttagttgagatagaactgcactatttactatcaaagtttttaaaatgattttacaaatgatattatctgatttaccaattacttaagtacttaggaaagttttatcataagatagttaaattttttaatagaaaactgaatattttatatttttcagcataagcatttttaatagattttggttatttcataaaatcctccatgaaaattattggtaaaagttttccgtatttataaatagagtaagattatagtttgaactcaagaggttaaggaaaaataaggcttttcattttttcactatcattagttgaatatttttgatataaaagttaaaaaaattcccttgaggaaaacactgaaaacactataaccacatatgtttaatcgttcatttatttattcttccctcaaaaaattaatctccatataaaccattgtcaaaaaaaatttcagcatcagatggctggcttcttcagcttgcccatttaagagattctatttttttaaatctgtaaagcatgtaaacctgagtatatgtcctaaagattaagaacattatttttagttaagatgactcaagatagtcttaacatgtatgcatactaggaagagaaaataagataaatgaatttagtgtggagaactatttaacagcagatatgttcaaatgattttagacaagcgaaccaagattattcaagcggaaagggtggtcttctcagtaaatggtgctgggaaaatggcatagtcacatgcaacgaatcaaattggacctttacctaacaatacacaacatggatcaaagacctaaacgcaagagctaggactatacaacactcagaagaaaacacaggagaaaagcttcataacattagaatttgcattgattttttgaatatgacatttaaggtacaggcaacaaaagaataaataagcaaataggaattcattagaatgaaaaacttttgttcatcaaaggatattatcaatacagttaaaaaaaacccagagagaaaatatttgcaaatcacatattctgataatggattaatatccagaatatatagagaatgtataaaactcaacaacagcaacaacaacaacaataaacaaacaacccgattcaaaaatggggaaaggactaaataaaacagacatttttttcaaagaaaatatacccatggtcatctgtatcttgaaaaactcattaaaagatgctgaatatcgctaatcatttggaaaatataaatcaaaaccacagtgagatacaactttaccctcattaggatgcctagtatcccaggaatcaaatattaatttttgaaggggatatggagaaattggaaacttcatgaactgctgatgggatggtaaaatggtgcagctgttatggaaaatattattttgttcctcaaaagttaaaaatagaatcactatattatccaacagttcacttctgagtttacaggcaaaataattaagaatggagacgtggacatatatttgtacactcacattagtagcagcattatccagaattgccaaaattggaagcaacccaaatgtccattcatgaatgagtagacaaaatgtggtacatacatacagtggcatataatttagccttaaaaaggaaggaaattctgacatatgctacaacatggatgaaccttaaagatattatgctaagcgataagccagtcataaaaggacaaatactatatgatagcactcatttaagttacctagggtagtacaattcatacagacagaaagtaaaatggtagttgcctggattgggggaagaggaaatagagagttattgcttattaggtacagaggtttagtttgtgatgatgagaagagttctgaggacaaatagtggcaatggttgtacgatgtaaatatacttaatgtcactgaacttcacacttaaaaatggttaaaatggcacattttatgttatatatattttaacatgacttgtaaaacaaatactgttttacaaaatctccacgatagtctagttggccttgggccaaagaaaggaaggagttcatgaagcactcgtcaaagaacgaaaaataactcacttgtttctcagctgtactggctttaactcttataaaaggcaaggcagagaaaagaaaaaaaaatgagagcagaaatccatggcaacaagcaattttttttattattgatagcatcttaggggaattaagtatctggctgctaaagagaccaagtttgtgtgaaatcttatgagtccatttactctattctgattgaccaaacagaaaattaatacctgttctatattcataagaaatatatttttgtatttttgtctgacaaaacattccaatatcacaattgtttcaggagttattaattaagagtacagcattaaaaaggggacaacaaataagcattgaggcagaaagcagacaataaaataatcatgggtagtaatgtagccagcctaaaagtactgggtattattggcctgatgagtgtagtacatgacaagttacataatctttagctttggtaaaagaaaaattaaggtaaacaattgactttagatgactttctaaatttgaaagagtactactgatatataatcttgttttataaacactaagataataaaaggtttaacagggtttagcaaagttcaaatatctcaattcagttcttactacaatatctgtttaagaatggaaacaccccattcactaactggacttcaaaagacatttattttagtcagcttgtagagtggctgaactacataaaatttagagaatacaaaacacatctaaatattttagtaaccctcacattataaagtaagtgatatggtttggatttgtgtctctgcccaaatatcatctcaaattgtaatccataatgttggaggtggggcctgatgggaggtaattggatcatggggctggatttccttcttggtgctgttctcatgataatgagtgaggaatccagatttggttgtttaaaactgtgtgctacctgaacccatctcctccccgcagtgcctgctctggccatgtgaagatgtgccttcttcccctttgtcttctgccatgattgtaagtttccttaggcctgcccagccatgtttcctgtacagcctgcagaattataagccaatgaaacatcttttcattataaattacccagtctcagttattcctttatagcagtgtgagaaaaaactactatagaaacctggtactaggagtcaggtattgctatgaagatagctgaaaatgtggaagtgactttgaaactgggtaatgtgcagaggttggaagagtttggaggactcagaagaagacaggaagatgatagaaagtttagaacttcctagagatttgttgaatgattgtgaccaaaacgctgatagtgatatagacagcaaaggccacgttgacgaggtctcagatggagatgaagaacttactgggaactggagtgaaggtcacttttgttatgcactagcaaattgagggagcattgtgcccctgccctaaggatctgtgggactttgaacttgagaatggtgatttagggtatctggtggaagaaatttctaagtagcaaagtgttcaagatatagcctggatgcttctagccttctatgttcatattcatgtgcaaagaaatgatgcaaaactgaaacttaaatttacaaaagaaggagagcgtagatgttaggaaaatttgcagcctggccatgtggtagaaaaaaaaaacaattttcaggggaggaattcaagccagctgcagaatttttcaaaattaaaaggaaagcaagtagtaatatccaagacaatggggaaaaggtcctgagtatatatcagagaactttgtggtggcccctcccatcctaggcctggagacataggagggaacaatggtttcatgggccagacccagggccccccctgccctgtgcagcctcaggacactgcttcttggatcttggctgttccagctctccagctgtcccttaaaggggtccaggtactcaaactcctgcttcagaaggtgcaagtcataagccttggtagcttccatgtggctatgcagagtgcaattgttgaggcttgggaccctctgcctagatttcagaagatgtacggaaaatcctggatgtccaggtagaagactcctgcagaggcagagccctcatggagaacctctactagggcactgcagagacaatatgtgggttaagagcccccacacagagtccccactggtgcattgtctagtggagctgtgagaagagggccaccaccttccagaccccagaatgatacaccaacagtttgcaccgtgcacctagaaaagtggcaagcattcaatgttagcccatgagagcagctgtggggactagccctatagagccacaggggtaggtctggccaaggctttgggagacaaccctttgcatcagtgtggcctggatgtgagacatggagtcaaaaaagattattttggagtttgagatttaataactgttctgctgggttttggatttgcatggggcttctagcccctttagtttggctgatttctcccttttggaacgggagtatctaaccaattcctgtactcccattgtatcttgggatcaactaacttgtttttgattttacagtctcataggcagaagggactagccttgtctcagataagactaaactttggccttttgagttaatgctggaattagttaagagttttggggaccgtgaggaaggcatgattgtattttgaaatgtgagaacatgagatttgggagggacacagggaagaatgatgtggtttggatttgtgtccatgcccaaatctcatgctactctcatgatagtcagtgagtgctcacaagatttgtttgtttaaaagtgtgtggcatcaacccctctctatcttactcctgctctggccatgtgaagatgtttctgcttcccctgcaccttacaccatgattgtaagtttcctgaggcctccccagacatgcttcctttacagtttgtggaaccgtgagccaatacaaattcgtttctttataaattactcagtctcagttatctctttataggagttcgagaaccaactaatacaatcagtgaaccaacttctttggttgtcagtatctatctgggaaaccccagagggttaacatgtagaagacattgcaacagctttttttttttttttttttttttataattccagatttggaggctgaattgaaaaaggcaaaagatttgagaacattgattaagatactggatattgtaattgattaaaatcaaggaaattgctactttttattttagagagagattacttaaagctaacacagtagaaagcaacaaaagtaagtccctgtagcaataagtaacttctattaaaatgatttaaaatactgcaatggcagcaaaaacattaaaaggtgcatagtgtctcaaaaagcaggtgaatatactacgacccagtttacatattttcatgtctaacaatagtacaagtatagtatcaacaatgtataaccagatatttgaattacaaccagtaaccaaagtatccaacttctgtttccttaaaaattgacagagaaaactaaaagacaagtaaccccaaactacatgctatggtattccatgagcatacattggatatccactttataattttataggagcaaaaataaacttgtatgttgacattatccaaaatcatttatacatcctctaatccattaattaatgaccataacgtaatgtctatacatgagaaacaaggtcaaaataatatgatttagatattttgccttacctagaaagtgttattatgcaaatatcactaataaatgatctaaattaaatctttacctaaagtagatgtcagcaaatgaatgccaatagaatacattcagcctatcttaatttttttgtacagactgttcttctaactgcctacaaattaggaattgttcttacatgcccattgacaatgagttctcatttgatttattagttctctcttggagtattaaagtattacaatttgaagaaaattttcagtatttttaaaacagaaaatgatgtccatttttgtcccctttagaggagctatttttgataaaccaaaaaaaaaaaaaatacaaagcagaaacagagaccctgttatcaacttaaaatattgatccactaaaacaaaaacaggattaattaacaattggtctcccagggaaatatcattttcaaggttctgagtaattttatgattctaacatatatttgacagataccaaagaaaataattctggtggtttatacattctccaaaaatctttaagagattagctgtaaagcatatgtgataagcagtctccatggaatgtatgccaggaagggtcctgtattaagtttatgctaattagtacagatcttcacattactgtagtaacatctcatcaattttatatgtaaattctaaattcaattgctttaggctaaaatataaaaagcaaatattttaagctgtataaataataaaataatatctttataacaggtaaaaatatcataaggtaaaaggttaatttattagaaatatattggtgtatttcacaaaatagcctcaagaaaatctataaacagaaaataaatattaagttgatctttctccttttattgcttctattattttttttcttccctccacctgctgccaagttgccctcacttttcattattgtggcaaatcatttttatgcacttctccacatgatacaaagcatactcttttagaactcatgtgattggccctagtgttttctcagacccccacgttcaaagcttgacataggttactctgttttcagataaatctgccacaaccaaaggggaagattatataaatacaagacaaattttaagtaaaactttaaaaatgaagttgaaagagtgcatgtttccagagcagtggatgttttgggaatgtccatatctttggctacacatcgctacgttaagacataaacacataaaactaaacaaataatattgtctagagttaaatatattatttttgtatgtatcagagaatagatttatgagctgaattagtaaacagaaatatttttgaacacgtcacaggacttttccctctcagtgtctgagttttttcactgctgcaagtgagatgttgaatcaaaacatctttctacaaacaataaatgatccaatgtaaaaagagtaggaagtaaccattgccacaaaaacatctctttgattatttttcaaaataacataaatgtttattttttcaaggaaataatttcccatatgcccaatatttagaatatataatatatatctttatggcttctttcatattgttggtttaaatgtattgtatgttgcattaagactaaaagacagggtatctgagcctgacaatcagtcaagtatggaagggaaatctctaagttctatgcttggaaaatgatgaacattcattgtattttaatactcaatcatgcccacatttgaacattttctctctctcttttttctttttctgtttcatttgcttccttcccgtagaagcattctactttctacaaagatttgttcggcaggtagcatggtataatgataagagtcaggcctgaattatgacactgaagttcccctataaattttagtggtttatatatcatgctataaaaatatcacattcttaatagtcatgctatctgcatgttttcatcaccctaagcctcagtgtcttcagctataaaactaaaatattattttaattattaaataagattgttactgaaacatcacaggtctacgtcctgttgctcactgcacagaaagccaatcactgagttaacaaggattgccaggtgatatgatttggttgtgttcacacccaaatgtcatcttgaattgtatctcccataattgccatgtattgtggaagggacccggtgggacataactgagtcatggtggcagtttcccctatactgttctagtggtactgaagaagtctcacaagacctgatggttttataaggggaaacccttttggcttggttctcattctctcttgtctgctgccgtttaagaggtgcctttcaccttccgccatgattctgaggcctccccagtcatgtggaaccgtgagcccgttaaacctctttttctttggaaattagtctcgggtatgtctttatcagcagtgtgagagcagactaatacatgagggaaccaggctttactttgggtgctgcacccaagaataacaggtaatacagtctctaaatctgtttctctaacatagcaaaaatggggtgtttatatagcagggaaggcaggaaaacaggaattagggagaggtaaggaagcaatcatgaggaatgaagtttattgcatctttttgtctgatccggatgtggtaatctagtgagtttcagtccctcacctgagggttggtttcctgaggagggaactcagatgagataaatgtaagttgcaagttttaagacaagggagggtcaatttctatgtctatttttaaaaacctatagatattttttgtatgggacaatttggctggtatcagtatcccctttctatttatcaattcctccatcatggggaatctggttgtcaatctttctggctgcttcttgctgaggagagctattatgggataatgctgaggaatgcaaaccttactcctgtaattgaaagcactcatgagcacctgaccagcatctggcttgttggagcaccatgacctagatagttttatcttggtttagaacaacatagtaagccacattgcctaggatgcttagtaacatagataaaccaaattttaaaataaaaccaaattttaaaataccagagaatatggagctgatcccctggggaatcccagagtgtaactctaatgctaccaaaaacttttcctgatgcattacatcctgcatgcataaagctatggtttcaggaagagcaacaacctgaaaagcacatggtccctttatgatttcttatccaggctctttggctgggctttgaatactaactttggccctctgagggttcataagcccatgacctgtttcccctggagggatcaaaaagggcttggttttaactgagtatgagtagtaaatatatttcatcttaaagccagtctcccgtgacttggatatgaagcatatcagctgcttcatctggggtgtttcacttggcattgatatgtgaagtttggcaattctccctctcggggtaaacagatcttacggtggcatttatccaatccaccaggctggctgttctctcggaaataacctcctgtgtgtctgaattacatatacccatctgtgattgttcaacagtgagctgtaggtcctgcatcaaccaaaacatgcatttccattctacaccatttaaaaccaaagtcagtgctcccaggttcgttaatctcataatctgttttagaaaagctgatgataccaatctacaaaatgaaacaatttctttacattgtaccctctgttttttttccatttatttatttattttattatactttaagttttagggtacatgtgcacaacgtgcaggttagttacatatgtatacatgtgccatgttggtgtgttgcacccagtaactcgtcatttaacattaggtatatctccaaatgctatccctcccccctcctaccaccccacaataggccccagtgtgtgatgttccccttccttcccccactttgcctaccttctggaaaaggcaggtctcagaggtactttctggtgctctggcataatttttccttttgtgggtagtcttgaggctacttatttgagctcagaaagttccacatctgagttggtccagccccaacacccaactcagcattctcttactttcattttagctattatagataacaaaccaagggattgcatgttttgctttttctttattcgtttgcatttccttatgcatcctgtgaactaattccctgggagtagaatctatctctaaattccatggtagcttttatcttaaataactgaacgcagcacaactgcaactctacacaataggtgaccaggtttccaccaaggaatcaaaagctaatctaatagagggcatactatagttttcttctgaaacataaatttttctctctttagtcaacaatttcaaccaaagacaaattgtggtagaaccaatttatttgcaatataagtttccatctatcatacttggcctggttatttgcataatgtgcctcaagaattattgtccatataggatcttttatattggggctttgctggactttttataaggaatctcagatttgactattaaaggcctctcaagcccaggcaaggatttatctctgccagcaggtgtctgtatgaactgggtgaattcctctcttctcaaggtcccaaaataacttaaggttcctggtcctgtcagaaagtgacattctttactcatcacagatcaggaaacttataaagggaccagttagacaaaatactagaccagtctttccaaggaacttttatcggctccataaatcaacctcaatctctgaaggcattctgctcatatctgagaatatatcattccagtcaaagctttgggaaaataaccagtgtttccaaatgtgtcctattacaaaagaaaacaaattcttattgaacatatgcaaataaacatattgccatgaattaagaatattcatagatgatttccaaaatctggagaaatcaggtagagaaagaaaaatatgcattaaattggtttacaagaatatattcaattgttaaaggctataaatatctaaaaataaagaaaaaatcttttatcaaccctcaaaaataaaacaaaacaccaatgtttcattataaaaaagccatacaaaattagtttggtcctttattagttcagtctatgcaattaactcttgtcctgcttcacattgggttaacaatctttctgaacacatcagtcttttaattagagtcctgaaagttctttctctagtccaatggcacatttctagagagagaaagttatctctctagtctctttgtgccattgcaaagttatcaaacacttgcattcaacagtttttttcatgaatttccctaaagaaagaagtttggaactgtagctaactgtaagccacttttttgacaagcatcaaagtaaaacaataattttgaatgataaaggtcttaggacagttctggttaaagacaagccttaggttagccataattaaagacacaattgataaggaaattcacttatttttttggcatacaacaataataatcataagtattgctgataacatatacttaagacatatcagaattttaggaatctcatacaaatttggaacacatgttcataacatacttacataaatataaccccaaagaaagttaaacaccatttcatgtttgaaaatgcttcctttataattttaacataccatataagcttactatgcctctcttggacttcaggggatgtaatatctaaaaagttattttaacatccaaaagactaaatttagaacttgaaactttgatattggaaagtttgtcaaatatcaaaggattaaaacacttactatcacaaaataggattataggtcattataaaatagtcattcacttagccaaaatgataattccaagatttttttaaaagcaaaaacctttattctttgatagagactcagtttcccaaacaataagaccttataaagacagcatgtgcctaactaaatctctctccctcccctcctttatgcccctgaagtttactcaaaaggtaaacaataatctttatatctcttattaatgttacatgaaaattttgttcaaaaggtaaaaccagaatttacctttgcatagtatattgttaatgttcaagcctataaaaccttataagtaaatctaattttaatatttgaccataatgtaagatttccttttatgaccttttactattttctattaaagaaaagatcagcgcacccagacactggtctcgcatcactgtgcctttgatattaatgtttaatttatagaaaaactctgaaccattcttatccctcaaaacaggcctttacaatctcatgcaccacctcttctgcaatagtccttgggcctagagggattgagaagttttaatttctgaccctgtgttttagcaaagcagttcatttcgattgctgctatctccaaggtctgaaaaagaggtgttgactaatgtcaacattcaagacttggcaggagtcaatgctttcttcagatccgggagtcaaagccctgtgatgtaacagcacaaggactttaaaagcaatatagaaagtcacatggatgtaaaaacctttgaaatctcagttttcctaagcaatcagaaacctaataatcatgacctaataatgatgacacaagaattattatgataaaatgtaaaatatcttccttaggctagttaccaaaaggcaaagaaaggccctctgttgtgtgattgtttctccttaagggaagaccatttagataatctgaaagtcaatcccgatgaataatttagacatatcaagaaaagtcaacagtacagaatcaagttacctgagggaaagcactgctttcctagaccatatatgagggttgaatttggcccatgggtttccattttgaagctctggcttgcaaattaggtactaataattggaataagactgtttagagaggaaagctacctggaaaagacattttggcaacactcaatatcagtcccacataaattgatggatgagagggaaaattatcctactttgagagatgataatgtaaaggcacaaaaatgaatgaaattcattatctgaaagagtctctaagaagaattaccttccttcaggggagaatactgtgaaataatgctggtgaaagaagcttgctatgtggaaagaaaaatgaatggtaatcaaggaatgatgagacattcttggtatctgggatggcaatttaactatatgaataaaagtacataaatgttctacttctagagaaacttactagaaaatagagatgaaatgaaataatgtctaaaatttgtttaaaataaccatgagtgagaggcaagagtaagacaatattacttatgtattgataattactaaaggtaactgaagggtacacagaaattcattgcactatataattttatatgttgtatatgtttgaacatttatataataaaagtttatatatcatgtttttatataataaaaggtttagaattaaaatagactaacacatagaatattggtgaaaatgaaaagtaaaaatcaaatgtaaggaatactatcaaatatacagcaataactggaaagctatattaaataatacaagaaataaagagaaacaactgaacttgagcctcagtttaaaaagcaaggccacatattttacaatggttccatgtctatttaagacaagaagaagccgatgaactaaaattattttcagtctaccactgtgactttaagtaacattacaaaaaattcaagtggaaatagactcccatactaaatttggtgtatctccgggcaggcatcattgtccatatggataaaaggcaatgaaaccacccccactgtttcatagaactgatgtttacagtttttaacttatatttgtcttatctgagttccttccttaggaaattgaccctcaggcaagaaaccgaaactcaccaaactactgcaccccaacaatgggataccaaagccctcatccaacataattgcttccttactcctcccaaattccagtttccttacatggagctacattcctcctccactgtgtaaaccccaaattttagttggttgagagagacaacagtaagcagcaggatgtaggctgagtcccaggcattttggtaataagaatacaaaataaaccaaaaatgcatccctagcaccagctcagtgtcttctacacaatagaaatgatgcttcaacctttgacaagctctctacatatgggcttttttttgttttagcttctataattgcctttgctatgacaaaaggaatttgcaaacacaatatgacaacattttatatctggcattgaataaaacatttatttgaacttagaaaatgattcaattaccctaggctgttgaactaatctcatacaatgtaatttggttttaaggaaaaaacttattctactggaggtctaataaactctaaaaaccatacagtccacaatatatttgttactcagcttattctttagttttctctttaataaaattaaattatgtaagaccctaaagaataactctaagcaaaagaattatctttaagatttgtcaaatatattccttggaaattgtttcttaaaaaacagaataatctcttaaggcaacacattgatattgttatttgaatataattactttaatcatgaaattttacgggaatttgttaggaattgttgaaaagagagctcaagaactcctttttattttgtagacctaagtattttatggccttatttgtgaggaatttgtacagaggtctcgttctataagctatacaaacaaatattgtaaaccagcaagtaaatgctgtctctctggcatttgtaatttaaatcttaagaatttttgtaaagttgcttttagaaagttggccgggccgggtggctcatgcctgtaatcccagcgctttggaaggctgaggcgggtggatcaccttagtgaggtcaggagtttaagagcagcctggccattacactaaaacgccatctccactaaaataatacaaaaattagctagctgtggtggcacgcatgtgtaatcccagctactcaagaggctgaggcattgaacccaggaggtgaagtttgcagcagtgagccaagatcgcgccactgcactccagtctgggcgacagagcgaaaaaaaaaaaaaaattatgccaggattggggggaaaatggtgggtaggaggcaaaaataacttgcagctctcactcagacagagcagtgtgtggagacccacattatgaacttttgctccaagaactaccacaggaacataccagaaaaagtaagagagtccacagacccttttgaaggaggtggattgctgctactggttctgtgggacagcagaacagcaggggaactcctaagacaaaggacataatcccttgggagctctatggccctgcccaccgcctgagaaaccttaatacttatccaaaggtgaccctagggcaaatttgtatcctccctaaacaaccgcagctgaggtgctcttgaaagcgccacctcctggctagaggccagtcaacacaaaagcagtgcacttaacaaacattcagccaaggacccacacagagtccaccccctgctacctccacagagcaggtgctggtatccatgggctgagagacctaaagatggatcacatcacatactctttgcatatactccccagtaccagcctggagcccagtagttctgctgggcggctagttccagaagagaaataacaatcactgcagcttggctctcaggaagccccatccctagtggaaaggggaaaacaccatatcaagggatcactctgttggacaaaagaatctaaatagcagcccttgagtcccaaattgtccttccaacataatctacccaaatgagaagggctcagaaaaacaattctggtaatacggcaaaacacggttctttaacacccccaaaagatcacactattttaccaaaaatggatccaaaccaagacaaaaatctcgaattgccaggaaaagaattcatgacagctgtaaagctaatcaagggacaccagagaaaggtgaagtccaacttaaataaataaataaataaataaataaaaaatacaggatatagatagaaaaatctccagtgaaatagattgcataaattaaaaaaacctacaacttctggaaatgaaggacacacttagagaattgcaaaatgcactggaaattctcagcagtagaatcaaacaacagaagaaagaatgtcagagtttaaagacaagggtgttgaattaattcaatctgaaaaaagacaaaagagaattttaaaaaaatgaacaaagaattaaattaaaacaaagataattaaattagagaacaaatagaattacatttttaaaaaatgaacaaaagagaattaaaaaaaatgtacaaagtctccaaaaaatttgcaattatgttaaatgaccaaacctaagaatagttggtgtgcccaagaaagaagagagatataaaaatttggaaaacatatttgaggaaataatgaaggaaaacttccctggccttggtagagatctagacatccaaatataagaagctcaaagaacaactgggaaattcatcacaaaaagatcacctaggcacatagtcatcaggttatctaaagtcaagacaaaggaagaaatcttaagggctgaaggcaaaagcatcagataacctataaaggaaaagctatcagtttaacagcatatttctcagtagaaaccctacaagtgagaagggattgggggcctatctttagcctccttaaacaaaacaattattagccaagaatttcatatccagtgaaactacatttcatcaatgaaggaaaaatacagtctctctcagacacacacacaaaaaatgctgagagtattcaccactaccaagccaggactataataactaaaaggatgtctaaatcttgaaacaaatcttcaaaatacaccaaaatactaatagaatctctttaaagcatacatttcacaggacctataaaacaacaacacaatgaaaaaaacccaaggtattcaggcaacaaataacatgatgaaaagaatagtacttcacgtctcaatactaacattgaatgtaaatggcctacatgctccaggtaaaagatacaaaatggcagaatgggtaagaattcaccaaccaagtatctgctgtcctcaagagactgacttgatgcataaggactcacataaactttaggtaaaggagtggaaaaagatatcccatgcaaatggacaccaaaagcgagcaggagtagctattcctatctcagaacaaatgaactttaaagtaacagcagttaaaaaagacaaagagggactttatataatgatataatgatatttacccaacaggaaaatatcagaatcctaaatatatatgtacctaacactagagttcccaaatttataaaacaattactaatagacctaagaaatgagatagacagcaatatagtaatagtgggggacttcaatactccactgacagcaccagacgggtcatcaagacagaaagtcaacaaagaaacaacggacctgaactataccccagaacaaatggacttaacagatacttatagaacattatactcaacaactacagaatatacatcctattcatcagcacatggaacattctccaagatagaacatatgataggccacaaaacaagtctcaacaaatttaagaaaatcaaaattatagcaagtgctctcttagaccacagtggaataaaattggaaatcaactccaaaaggaaatctcaaaaccatacaaatacatggaaattaaataacttgctcctaaatgattgttaggtcaacaataaaatcaagatgggagattaaaaaattcttcgaactgaacaataagagtgacacacctatcaaaacctctgggatacagcaaaagtggtgctaagaggaaagttcacagcattaaatgcctacatcaaaaagtctaaaaggtgcacaaacagacaatctaaggtcacacttcaaggagctagagaaacaagaacaagccaaacccaaacccagcagaagaaaagaaccaacatcagagcagaactaaatgaaattgaaacagaaaaaatacaaaaaataaatgaacaaaaagctgggtctcttaaaagatgaataaaattgatagaccattagtgagattaaccaagaaaagaagagagaagatccaaataagctcaattagaaatgaaaagggagatactacaatcaataccacagaaatacaaaagatcattcaaggatactatgaacacctttatgtgtataaactagaaaacccagaggagatgaataaattccagaaaacatacaaccctcccagattaaaccaggaagaaatagaaactctgagtagactaataataagcagcgagattgaaatggtaactacatagttaccgacaacaaaaaagtccaggaccagatggattcacatatgaattccatcagatattcaaagaagaactgaaccaatcctactggcacttttccaaaagatagagagagagggaatcttccctaaatcattctacgaagccagtgtcaccctagtaccaaaaccaggaaaggacataagaaaaataaaactacagaccaatatccctgatgagcatagatgcaaaaatcttcaacaaaatactagctaaccaaatccaacagcatatcaaaaagataatccaccgtgatcaagtgggtttcataccagggatgcagggatggtttaacatatgcatgtcaataaatatgatacaccacataaacagacttaaaaacaaaaattacacgatcatctcaatagctgcagaaaaagcacttgacaaaagccagcattgctttatgattaaaaccttcagcaaaatcagcatagaagggacatactttgtggtaataaaaaccatctctgacaaacccacagccaacattatactgaacgggaaaaggttgaaagtattccccctgagaactggagcaagtaagagatgcccactttcatgacttctattcaacgtagtattggaagtcctagccagagcaatcaggcaagagaaaaaaataaaaggcatctaaattggtaaagaggaagtcaaactatcactgtttgctgatgatatgatcatatacctagaaaacccttaaagactcatcaaaaaaatctcctagaactagtaaatgaattcagcaaagtttcaggatacaaaatgaatgcacaaaaatcagtagccctgctatacaccaacagcaacaaagatgagaataaaatcgagaactcaaccccttttacaaatactgcaagaataaataaaataaaataaaatatttaggactatatttaaccaaggaggtgaaagacctctacaaggaaaactacaaaacgctgctgaaaaaaatcatagatgacacaatactgccaaaagcaatcagacaaattcaatgcaatttccaccaaaataccaccatcattcttcacagaactagaaaaagcaattttaaaattcatatggaaccaaaaaagaggctgcatgcccaaagcaaggctaagcaaaaagaacaaactggaggcattacattacccgacttcaaactatactataaggccacagtcaccaaaacagaatgatactggtataaaaataggcatatagaacaatggaacataatagggaacccagaaataaagccaaatactaacagtcaactgatctttgacatagcaaacaaaaacataaagtggggaaaggacaccttattcaacaaatggtactgggataattggtaagccacatgtagaagaatgaaactggatcctcatctctcaccttatacaaaaatcaactcaagatggatcaaagacttaaatctaaagccagaaaccataaaaattctggaagataacattggaaaaacccttgtagacattggcttaggcaatgacttcatgaccaagaaccccaaagcaaacacaacaaaaacaaagataaatagatagaacttaattaaactaaaacgcttctacacagcaaaagaaataatcagtggtgcaaacaggtaacacacagagtgtttgaaaatcctcataatctacacatctgacaaagggctaatatccacaatctacaaggaactcaaacaaaccagcaagaaaaaaatccatcaaaaagtggacaaaggatgtgaatagacaattctcaaaagaagatatacaaatagccaacaaacatatgcaaaaatgatccacatcactgatgatcggggaaatgcaaatcaaaaccacaatgagataccatcttacttccacaagaatggccataataaaaaaaataaaaaaataatagatgttgtggtgaatgtggtgaaaatggaacacttttacactgttggtaggaatgtaaactagtacaaccactttggaaaatactgacttttgtaatttcattaaaacttgagaaaaggttgacaatcaagtgataaagttggaagtaaaatttctagataaacactttgcttctaaatatgttggtaatgttatatggaacataaaggaattcataaataaaataaaaggagctggtcactgttcacattggttttactttaatgtttgtcctctttcaaagttaaatagttgcatagccctgggaaatcatgctatcaactaaaggcaaacttcataccagaagattgcttaagtcttactaagataaaggaatggtccaatgcttatgtctgaaatgtccattattaattatacttctaacaaccatgtctgacttacaatagctaccacctttatcacttacataatttatttctgtgttatgctattttttacatttaaaagataaaaagaatttggtaataaggtttagttactaaaattggtgactaaaaaataaagtttagaaaagtttcctgttttgtcatctgataagagagcagaggaaatacatcatattaatattagattgtgagagtaaaaaatatgcaattactttatgtaaggataaaaattccccataagaattggtatctctgccagatatgatgagagacttgtaccaaatacgatgtatattctaatagaaagccaagtttcgtgaactatgtatcgcacataattacatgagatttctttaaaggatttctttagactttcacagatatagtagataaaatatttaactgtataattttctgcgttcagagtgatgaaagtcatttaactccccaaaaagttatgcatttgaagcaatattctgcagtactaatgaatcttacactcatcacccctgtgttccttcactcttctctagtttccgtcttgagctttcataaaaggaaagattgacaaaaaattatttgatcgcttccagctttaataccttataattttgcattctaactgtccagagatattgaatcctctataatatacaataatatgaacttacatatatttttgatgttactctgcttaaattatcaaagttaagctcacatctgagtaatgtatatcaaattcatgactaaacaggcaacttagagttatcagaaccaattttatcagagcccaaactatttgagtattttgcagaaaattagcttcaattttaattgtttctaatagatatgaatattagaataaaaatattttagaggaactatcaagaaataaatgtcttatcctatacataagaaagcaattattcccaaaatataattaagcctgaattattgaaatggatattatataggcatatttccaatttggcagtgattagattaaaaattatgatatagttatctaagtattaatttatatggcatttagattctcattctcttgaagcattccactatagtaacttaacagagtcaaatgtagtattttataggaaacaaggcaatgagcagtatctatcaattaagtttacttctgggatattttcctcaaaaaaatgaaagtatgcattttaaatattatttgtataaaatactattaatattatagtcatattgttaaactatgagtaaatatacatggtttctgtgaaaaaatataaaacctttgaatggttaactataaaatactaacattttaaaataagaaccatacaggctgggcacagtggctcaggcctctagtcccagcaccttgggaggctgaggcgggcagatcacgaggtcaggagatagagaccatcctaacaaacacgatgaaaccccgtctccactaaaaatacaaaaaattagccgggcgtggtggcgggggcctgtagtcccagctactcaggaggctgaggcaggagaatggtatgaacctgggaggcggagcttgcagtaagcctcccatggacatttaacccggcaggaggatcttcccagagatttaatggagactgtgctgcagcaggcacgaaactggggcctttgtgtgcaggacagctctggtggagcctggctgcttgtaagtgccagtcgcccagggctccctgtatctcactgagaggttacagccccagctaactgccagggcaggagacactagggctggcttccaatgggactgggacacagtccatcctgcagacctgcctgtccaaggctcctgcttggctgcacccacaggaatgtgggcatagtgcagcctctcctgccaagcctgtgtgctttgctccatctgagtgcacccctgcagcctgggggcccttgtgaccccagtgcaactggaaaccaaacattatggtctggaagagggtgctgcgagcagatcctcatgccccaaggccacagcctgtgctcaggagtcctgagctgggatctgtgcccaccattcaagtggggaaggagcccacactctcaaaactgaaaggggagagtcttagtttcgccagttactatgggacctaggtgtgcctcttccacagggttgtccctgctggaccttctgcctgtgggagccccgtgccctgaaacacctaacaaaaacaataacaaaatcatgggcacagtgccagtgatcagaaatggctcccccaaggccaaggagcagaccaagtgaggggttccttctctcccctttgcacttcagagcacagctgcaaattcgaggatacacaaaggagccacatggctgagtaggagccagtataccaccaattgccctcaagcaccattgacttgtttgcatcccaaactacagcaccaaaaaccaccgttaattcttcccatcgtgaaaccaggagtgagaattcaaaaacaaagaccctgtacagagacttagtcctctgaaaacttccagaaattaagccaatggactatgctcaatttataccacagtgaaaaggacacaaacccacccagatgagaaagaatcagggcaagaactctggcaataaaagaagtcagtgtgtcctgtgacttccaaaggagtccacagatccccagcaatagttcttaaccagtctgtaatgtctgaaatgacagatacagaattaagaatgtggatgccaaggaagatcaccgagaccaggcagaaagttgaaactcaatccaaggaagccaagcaatccagtaaaatgattcaagagctgaaagaagaaatagccatttttaaaaagacccaaactgaacttcttaagctgtaaaattctctagaagaatgtcacagtaaaattggaagtatcaacagcagaacagaccaagctgaggaaagaatcacagggctcaaagactagttctttcaatcaacacagtcagacagaaatttttaaaaagtaatgattagaaaaatgaacaaagcctgcaagaaatatgggattatgtaaagagaccaaatctatgacacattggcattcctgagagcaaaggagagacaacaagcaaactggtaaatatatttgaggatatcgtccacaaaaatttccctggaaaatctgatgattacatacctgtcttggggatgatcttgagtagaatgttgtgggagttgtctgtatttcctgaatttgattgttaccgtctctagcaaggctggggaagttttagtgaatgatatcttaaaatatgtcttccaagttgtttactttctccttgtcccttgcagggatgccagtgacttgttgatttgatctctttacataattgcatacttctcaaaggttttgttcattccttttcattcttttttctttatttttgtctgtcttatttcagaaaaccagtcttcaagttctaagattcttttctcggtttggtttattctgctgttgacacttgtgattgcattgtgaaaagcttgtattattcagctctggcagacccattagggtctttgtttataccagctatttcatccttcagctcctatatcgctttatcgggattcttcctttccttggattgggttttgccatcctgctaaatctcgatgatcttcattcctatccatatactgaatgctatttctgtcatttatgccagttcagtctggtcaggaacccttgctggagagaactggtgtggtaatttggaggacatacaaactctggccatttcagctactggagttcttgcattgtttctttctcatctctgttgtgggtgttcctttaactgaactgtagattgagtacagtcaacagacttcttttctgagtgttttcaccaggctatatttaagtcagatatcatctttacaaggtaccttggaggatgctgctaagctactcagcaggagcagtgggctagagtaaattcttacggaatcatgtagactctcactgtttctttgactttctctcttatgtttccccactccatgccattgtcattggctttctacttgtctgtcaaacacctcaatctcatgctagtattctgtttcacagttactctgcctgtaacatttttccctgtgatgcccatccacctggttactttcatcatctcccccaagtctttatgtgtcatcttctcaatgaggcaatctctgactactgtatttaaaattgcaatgtgatccctatctcttccagttacccctagaatcttaatcctctttatactgctctactttttaaatcaatgcactagttacctgatagcatactgtagaactgcttgatttattatgtttgttgtgtatttcatctctcccttcattgaatgatgtaagatcattaagggcaagcatattttttaatgtttcattcattgatgtagcgtcagtgtcaagaaaagcgcttggaatacaggaagcattcagttaatatttatgaaatacatgaatgaatgattagggaatgaatgcacagcttctctctattatatattcatcatggaagatacatttttaaaaatccattgtattagaataatacacgaacgaaatgcatacaggcttaatgagttacatttacgtttggtaagaggttttataaagaggatttacttgattttgtgggtataaatactttcaggatttaaaaattgcaatgtgtatgttttcattaataaaataaggaaaaaagtctgaatgtctgtcaaaactaaggaaaacaagcctacatgtctgcctctatgactgtgtaaaatcaaagaatgctttgggagcctggagcaagaagaaaaagctgaactatgcatatttgacttcagaaacacatggctgtgcaatcactttcaatattcaaaattaaaattagaaaagcaatattggaggaatggctggggagtagcttaggaggaatctgataggatatacattaaggaagatcttgagtttgcaataagagactgtttactgagcctggatgtttgggttcttcagaactattaaacctccttcagacttgaccagtcaatacaaataaattaaatgtttattctgctcatctccttcacttgaaataactggaattctttgctgaatggaaaaaaatagcactgggaaaaaatagagctcttttcttggtatggtagctttgagacaatgggttagtctacttgtaactattgcattctactgctttgattacattctctaagagctaacaccaaaaatgtaaaggtagacaggggaggcaataactggtatccaagtttttcctaatgataaaacagcttgtcttaacaatccttgacatataataaattcttaaatttctaattaagttccttattctccaatacagtagtccccaatagacaatagcatcaataaaccagtaatttatgcatttgttaaatatttatttagatcacctgctatatgcctttaaacattttaggcatttcaattcacaaagataaattctaaaatatgcatgccatcttaaatcacagtcaaacttgtgtgagaggttggggcacagatgagaaggactgggcagtgtggaaaggatatgctagaaagatacacctggtggaaataaaagggcttgattactaaggcttttttttaccttctgatttattttcttcagtgatctttgcctcttccatgattttagtaatcatttataagtgcagaatcataaatgtttatctcaacactggcattttttgaggtccatgcttcaatgttcaattgcttactctatatcacaattggatatcctaaagcatcctaacagaatgtgtgagaaactgattatacaactcacatctgcatgttttcttaaaaataaactcacatgcacaaaaatgcttgttattcctccagtgttcatatggtgactcctttttgccttattctccctatccaatctattttttgcttttctaattcatcattgtcttcttcttacatacaacttttgcctttatccaaagtttataaaatgtgtaatctcttttattatataattaaccttctgtgcttgcccataggctaattctaagattgggacattaaactgtttctatttttataaaccttattttctgacatgctctataacttttatctacccatttatatagagttgtaaggatctattttacacctttttctactctgctttctaccttgagagtctgacatctcttgacagcagcatgaagccccctctctctttagatttcagatgtatttggccaactgagactctaaacaggaaatctgagagaaaaagggaagcttttattattacttattattattccccacccttggctcccttcatgaagtactggctcttactggctttgtcccttcatcgaagctcataatgtccttctgagcagccctctctatattactctctccttctaagtttctgaaaatgctcttcctattttcttagggcttggtaaatacctcttctctgttcctactagctaagagtactgcagtaaaccttgtggttttcttaaatgatgacgcacatttgttaacagccctttaattaaccctccttgaattatcctaaattgagtaagccatctgtttcctgctgtgaccctgacctgcaaaatcatcttttttttcaaatttgcttattgtgaaaaaaatataattctttcaatcaatctctctgctaaaattaaattgttctaaaactcaaggtcaagttgactctcttattttttttacactttcttaaatgctgtaagtactgacagttcaaatttgagtcatatctttcctgtacacttcttattttctctagtttctaagtgtacttatttcatgtgttgacaaagacagcatatggatttatactaagctcatctacttccattactatatttttgttagcattaatgcatttatctgaaatatattattctcagatatctatgatttataagtctaatttggactacgtgtgttccaagtctattaggcagtttgttatacttggatgacaaactttggagctggaattgatgtttgctaaaataagaaatatgcatacaaaacagcttacacaacagctatttaatcttataatttagagttgaactttaaatatactcttaatcacatcaaaatgtcaaaaagaggttggaaaacacacaaaggtttaatttatctgcaattgtaggaggtgtttcatcagatattctcattagcaaatttaattataggaagcaagacaatattactttatagctttaagatctaattagtgttcagaagttagtctaaattaacttacacatcaagcagctcaaacattttccattctatggggaatttcactgggtaaaaaatcttttgtcttgtgggctttaaaattcacacagctgtacaaacaaataatgactgcaaagtggttctagagtttttttttcaagaggcttttgggctttggtttcaaataaatacaactatgtaattttttatcaatgcattagtatcatacatttataattaatatatattagtcatcactcccatatatacatatatgtgtgtatatatagtatatatattaaatattatatagtatatacatagtattgatatgatggtaaagactaggtttattttcaaataaaagttaaaataattagaaaagcattaaggaaaaaatagtttcaaatttttttgatccagttaccattttgtttgcttaaggggaagccaaaaagacttccttccaaaactaaaattatcatgcatatagagcagtactctttcccagaactcatgctatctgtaaaaaattttccaatttctgatctcatcctcactttaactgtgtaaggcattttgtatttccttctgttgcaagacactcaaatgactctaactgttgaacatggattgatgtatctggtggtgagatctgcatgaacatattttcatattttatttttaacttgaggaaattcctgagtgcagtagaattatttatgggcacttagagtcatggataggtgggtgtggaataggacaagaaatcatgttatccattcccttacccggttttctaatcctgctttataaaccctatggaagaagtgtagactggcaccaaagatctgccttcattagttctgtaaaatgcaagagcaaattctggttattgtttttttcaggcaaaaagcaaagtgtcattttagaataggattttctcattatcttcctttttctttccagtcttctgtccttactttccttctttttatccactttctccttccttcatcaacggaattatccagggaatattgttataaacagaataaatggtagaaatgttgcttaaccattcccttcctaagaagttagaatattcttccaaaaatatcaaactttgtcaattttatgtgtaagtttgacaagacttcaaagaacactgactttagctttaaacaatttctttcagacaataagaaaaaaggaatgactacttggattatttcaaagcataatctttataaattttcatactaaaaccaagaaagaaaatcaatggccactttttattaatgttggttataaaaataataattttaaacgataatttcaaaatatatttataacatttccagaatcaaaattgagtcaccattaataaattcattaatccatttctccatgtaagtgtttaaagaaaaaattctcaatgctactactatggttccgatgtggtttgcaccaccccctaccaaaactcatgttgaaatttaattgtcaatgtaaccatgttgagtggtggaaccttaagggaggaggcctactgggaagagttcaggtcatatcaacttttcccttatgggcctcttggtgcccttctctcagtagttagtgagttcttgctctcaaggaaatggatcagttctcagaaaagcagattgttacaaagtgaagtccctcctcatgtttggttccttttcacacgtgtccaccttccctttgaccttcttccctgtgttttgacctagcatgtgacccttaccagaaggcaagcaggtgccaatcccgtgccctttaaatttcccagactgcagaaccgtgagctaaataagccttttttctttataaattgcccagcctcaggtattctattatagcaacgcaagatggactaacccaactcttttctatttgttttctctaggtaggctcagagccttctagagtgtaataatggctccccaaagatgttttcatcctaatccccaaaacctgtgaatactgtgaatgtattaccttttatggcaaaagggaacttgcagttatgattaagactcctgatatgagaaggctattctgaattatccacatgggctgaatgtattcacaaaggttcttgtaagacttaggcaaaagtatcagagtcagagaaagagatgtgaggatgcaagcagagatggggcaaggaagaggggcaaaattgtttgactatattacattgttggcgttggagatggaggaagagaccctgaatcaaggaatgcagtagtcctctggaagctaaaaattcaaaggaaaatgaagttctcctaaagtgtcttcagggaacacagccctgcttaaacctccattctagccatgcaaccaatttctgacttctaaattccagaactctaaggaaacaaatttgtgttattcaacccaataagaataatatatagcaataagaattaacatattctccaacaaaaaatgccttttatcatgaagtcaggctgtaaagtcaacctgactgcgctcagttctcaggtgtgacactagcggcgtatatggaaaaagttgcttatttttctgcatattctcattacagaaccttatagacatacattaagcacttactactagaaactgagtaaacactcaacaaatttcaggtattgtgactcatgatctcttattttattgtttcctggattgatttcaaattcctcagcctggaaatcaaagacctatataacctggctccaaatgtgctttacaaacaattccaacaagtcacctcaggggtcatccttctcctctaaagaaaaaaaaaaaaaaagaaaaaacaattcattcttgctccttcctgttcctgaatgattttctcctctttcttgattatttgaatttcatactgacttgaatatccaagtacaattttacttaatctgtgtggcctttccagcttacttcattactgagttctggttctttcaatttaacatttgtttattcaattcaaaaagtgtctgaagtgacttgtctgcaacactaatttagcagttaagcttgtgtaagggagatgaaactttacctctactcttttagggtcctgtatgggcctgagaattacatagacataaaacagattaacagaagaaaagcatacaaatttaatgtaaattttagatgacacaggagcccgcataagaaaatgaagactcaaagaagtggcaagactcatctttttttgcgttaggttgaacgaagagaggcaattgtggaaaagtaaataaattatatggggaggctgaaggaaaataacagttattttaccaatgtctgtttttacataattctctcagctatgactctccattgaagaatgtgtcttttcagctggtacagctcagacatctttcacggaggcctttttatctcttgttttcagggagaaaagaagattagaatgcctttcttgcatttgctgtttttcaagttcctttagctcaaaataatacttaggactcagtggcctattatggggtggcatattctgccactctccactttcttttctgatgtcatttgttaatatctaacacagataattcttttagtgtttaacattttgtgggaaaatgtggctaggcttttacagaattgtatacaaccatattccggaatttttaattaaattataagatcataagtataaagataagtaatctctgctgcagatataatagcatcaagataataaatattcactatgtaatgatgacataaatctctggacagagatataataattatttgatatataggaacatttacatcagaatataaacaaataatacattttatttcacatttttaataatagtagaatttgctaatatataagatatatctaaaagaagtcaatgatcatttaaagaaaactcaatttgagcattttctgtgtccaaagaatgtacaaaaaaggtgaatctatgaaatggtatattaatgtgctgctaatgccaagaaaaccccgtgcttgatactatcttaacattgaataccaattttaaaatgcactgttactctaaggttgaatgtcatcaagaaaggtgttattgtagaaatggttttgtagcctatttgattacatatctgaaagaaaaatagggatattaacatcccaatacattctaaaatgtgacagtttctttagaactaaagacaagaagtcatgatttttgcaaagatttctgaaaataagtatttccttgtaatcaaatctaaaataataatggtaatattgaaatagttccttctgtattttgtaacagagaacaaagcgcctataatacatagcttcaagtatctccagatatctcaagaaagatggggaaaggcagtatcagtatcaccttgtaagtttataaaatatatatatatatatataccccatccttgccccagtcccttgtttaataaaacttgagccacctgcccagataatgatttcagtttagtttctaagttaactcatacaggtttagttcaccttatctcaaatagctgaaaccaaattgcttggattttggaggttttcagattttagaatatctgcatatatctatcccatcgtggggatgggactcaagtcaacacaaatttcacttatgtttcatatacagctcatacacataacctcaaggtaattttatacaactacttttgcataaagttgccactggtgcatccagcctgcccttgtgccattttattaaccttgtaggcatgattgggtaggggaatctgagcatgctcggaaaagatatgtggcagctgatggaggcaggaagggtcttttttcccttgcagacactaaataaacagttgtgcaccttcatttatttctggtgtcatgtcagtgctcaaaacatttaggaatttggagtattttgaattttagatttcagattagagatgctctacatatttcacagtgtgtgagggggtgtgggtgttggtgtgggtgtgtaggtgtgggtgcatgctacaaatataataccagggagccatgattccccgttttttatgtcttaatttgtctgcaaatcatagttttactagaaataaacaatacagggataaagcaaagaaattttgagcttggctccagatcacctcgataaagtggataccgcaataaagcaagtcacacaaatttctgaattcccagtgcatataaaaaatatgtttatattatactatagtttgttaagtgttcaatagtacacaccttaattaaaaaaatttaaaattgccttattgctaaaaaatgctaacagttatctaagcctttagtgatttgtaatctttgtgctggtggaaggtcctgccttgatgtggatggctgctgagatcaggatggtagtgtcgctaaaggttgaggtggctgtggcaacttcttaaaataagacaacaatgaaatttatcttatcaattgactcttcctcttataaaagttttctctgtagcatgtgatgctgtttgatagcattttaatcatattagaacttttttaaaaactggagtttatcctctcagactctgccactgctttatcaactatgtttctatactattttaaatgcttttctaatttcaacaatcctcgcagcatctttaccaggagtaggtcccatctgcagaaaccaatttttttactcatcagtaagcaactcctcatacattcaagttttatcatgagattgcaacaaagcatcttcaggctctacttctaattcttgttcttttattatttccaccacaactgtggaaacttcctccactgaagtcttgggcccctcaaagtcatttatgagggttgaaatcaacttcctttatactcctgttattaaactgctgttaatgttgatattttgtgctcctccaaaaaaaaaaaaagcaaaaaaacaagggttcttaatgatatctagaatggtgaaggctttccagaagacttttaatttactttgcccagattcactggagaaatcattacctatgacagctataaccttacaaaatgtatttcctgaacagtaagaaatgaaaatcaaaattgatccatgggctacagaatgaacaaatgcatgaaaacaacataaattccttgtatatctctatcagagtcattgggtgaccaagtgcattgtcaatgggcagtaatattttgaaaggaatatctgtctgagcagtaggtctcaacatggggcttaaaatatccagtaaaccattctgtaaatataataaatgtgctgtcatccaaggttttttgttgcatttatagaaaacaggcaaagttgatttagcataattcttaagggccataagatctttagaatgataaatgagcattggcttcaagttaaaatcaccacctgcattagcctctaacatgagagtccatctgtcctttgaagaagttttgaggctgggtattgacttctctctggccattaaagtcctagatgatatttttttccaatagaaggctgttttgtctacaccgaaaatcttttgttttgtgtaatcactctcatcaattattttattcagatcttttggattacttgttgcagcttctgcatcagcatttgctgcatcaccttgaccttttatgttaaaaagacagcttttttctttaaaccgcatgactgaatctcggtttgcatcaagcatttcttctgcagctttctctcctctctcagccttcacagaattgaagagagaaaggaccttgctctggattaggccttggttcaggggaatgttatagctggctttatcttccatctagactactaaaacttcctccatgtcggcagtaaggcattttagccttcttatcattcatatgttcactgcagtaacaattttgatctccttcaagaattttcctttgtattcacaacttgactaactggtgcaagaggcttaggttctggcctatctcagcttttgacatgatttttctcactaagctattaagcttagtgattacatttaatattaatgattacatttctagattttaaattaaaataagagatgtgctaattttcctttcactgaacacatagaggccattgtagggtgactggcctaatttcgatattgttgtgtctcagggaatagagaggtctaggaaaggatgaagtacaggggaactgcctgtcagtggagcagttagaacacacacatttcttgcttaagtctgccatttctatgggcaccagtgcctagcaccctaaaagaattacactagtaacatcaaagatcactgatcacaggtctccaaatcagacaccttaataatgaacagaaaattaaaatattgttgagaataaccaaaatgtgacacagagacacaaaatgagcacatgctgttggaaaaatggtgccaatagactggatagatgcagagtgctataaaccttcaatttttaacaaatactagatctataaagcagaataaagcaaagcacaataaagcaaggtaagtgtatatgtaaatttgtatcagaaatccaataacgtttttgataatctcttttgactccttgtaaatatattagtttgaaatactgttcaaaactttgttgaaatttagttcaatatgctccactttaaagggcataagttcttcacaaaattgtcttaaacaatacactaaatggaacagtcttccaatgcttcatgttaccaagagttgataaaaagtagctgagagtatgatatttaaatagttcctttctctaccaagtttcactagaaaattaagccataatgtcctaaagtatccattatatttgaactaacttttgttctgttccccttgattggactatttatgtactattcttggataaattgaagaaatctgacatcattttctgtctctgttgttcagatgaccaaccttgtcatctactgatacatacttatatgtggataaaataagtatttcctactaggagtaaataagtatttcttactaggagtaaaataagtatttcttactaggagttataatccatactttagctttcaatgtactggtttgtatctactggtctgtatgtaatgatcttgaaagctaacgtatggattataactcctagtaacaaaatacttattttatctaaattaattcagcagcctcttaaaggggtaggaagctactacactgtattataatgatttaaattctcaagtgaatttctatttatcatcttgccaaattaaaagcttttttttttcatttgctctgttagacatacaaatatctgctcatgatctgaactctagaggaagtatcttactccttaatacttttgcacattctgctccatgaagcctgactactcagagtccatcgtgattgtcctcagatgtttctaggctagttgtattttattgtaattacatatttaatttaatgccacataaatccatggaatataagtacaataagatggggacatttgtttttattatactgaaatagagtgcattggaagattacattgtggcaaataactgctgttgaacaagtgtgggtgaaatacctataaaactttgggaaaataatcataagctgcaataaagaatttttacaataagattgttttgcaagtgcctataagttttgtttctgttttcacaaagcaaagtaggaattcagacatattatcttctgaggtatggaagatctctgccactcagggaaaagctgcaaggaaatctatgcctttttctgcctacacataaatgaatatacggagtcctgttgtttttctagtgctttacacgtgaaatgagccttgattctccctaagcttctgcatatttaaaacttgtcatatacttatccttttttatgagagcatttaaaacatactgtacattgtcacctatcaaggtccctatcaaggggttcagtcaataaataaggaaataggctccttcttcctgcatcactggtttcattatcatttacattttctgccttataatttttattctataatttttataaaatgcctaatctatttagtttagactttgctatttataaatatattaaaactacaaattttcttttgaggatcaccttagatgcaaccaagatattatactgtgcaaaattttagtttttttaattggttttagtttatatttgttcttgggccaggaagaaggagcctatttccttatttattgactgaacgccttgatagggatcttaataggtgacaatgtacagtacattttaaatgctctcataaaaaagataagtatatgacaagttttaaatatgcagaagcttagggagaatcaaacctcatttcacatgttcttgggcacaagcattttctaagtgacagcttaaatactccaatggaaagaattttaataataataattgtgagtcctagagttgtggcactgtaatcagaacatggtttattgtatattgttgctttatataacccatttaagttttcattgttacttataggttcaattatcatgtatgtcctatggactgttgaaaagaaggtatacattctaaggctgtaatatttattaagatagaccttattaattagactatttgttgttcatttaagtctatcataattgaaaaggtaaataaaagacacttcattttttcatctattatctattttcttttggtaattactgcttaacaaatttgggaatatgttattgcaatcatggactttttttaaatttttaaatttttaatttttgtgagaacacagtactatatatttatggggtacacaagagttttggtagaggcatgcaatgcacaataatcacatcaggaataatggggtatccattccccttaagcatgtatcctttgcattacaaaaaaacacaattatactgtttcagctattttaaatgtgcagttaaattaccattgactatagtctccttgttgtgctatcaagtagtaggtcttattcattctaaatattttttggtacccattaatcatccctccacccccaactattcttcccagcctctggtaaccatccttctactatcatcatgagttaaattgttttcatttttagatcctacaacaagtgagaacaagtgatctttgtctttcttgccaggcttatttcacttaacataatgatctccaattctatccatgttttgcaattgacaagatctcgttcttttttatggctgaatagtactctattgtgtatacataacacattttctttatccattcatctgttgatgaacacataggttgtttccaaatcttagctattatgaacagtgctgcaactaacacaggagttcagatatgtcttcaatatactgatttcctttcttttgtgtatatgcccagcagtgggattgctggatcacatagtagctctactgttagttttttgaggaatctccaaactgttctccatagtggttgtactaatttacatccccaccaacaatgtataaaggtaaacctttcctccacatcttctccagaatttaaatgttattgcctgtcctttgcatataagccattttaactgaagtgactcgatatcccattatagttttgatttgcatttctctgataatcaatgatgttgaaaacatcttttcatatgcctgtcatttgtatgtcttcttttcagaaatgtctactgaaatgtttgcccatttttaaataggattattagattatttcccatagaggtgtctgagctccttaaatattctggttattaatcccttctcagatgggcaggttgcaaatattttcttcaattctttgggttgtctcttcacttcattgattgtttcctttgctgtgcagaagtttttaactaaatgtgatcccatttgtctatttttgcattggttgcctgttcttgcaaggtattattcaagaaatctttgcccagaccaatgtcctggagattttcctaaatgttttcttgtaacagtttgatagtttgaggtcttaaatttatgtctttagtctatttttatttgatttttatgtatggtgagagattctgcatatggatatccagtttcctcagcaccgtttattaaagagactgtcttccccagtgtatgttcttggcacttttgtcaaaaatgagctcactcaaggtgtgtgggtttgttactgggttctctactgtgttccattggtctacatgtctgtttttatgccaggatcatgctgttttggttcctataactctgtagtataatttgaagtcaggtaatgtgatccctccagttttgttatttttgcttcagatagctttgattttctggatctcttctggttccatataaattttaggatcgttttctcaaattctgtgaaggatgtcattgggatattgatagggattgcattgtatctgtagtttattttggataatataagcattttaacaatattaactccgatcaataaacatgaaatatctttctattttttggtgtcttcaatttctttcatcattattttatagtttttattatagagatccttcatttcttccattaattcctgagtatttaattttatgtgtggctatgtaaatgagattaccttttaaatttctttttcagattgttaactgttggcatatagaaatgctacttatttgtgtatgttgattttgtatgttgcaactttactgaatttgtttagcagttgtaactgttgtttttgtggagtctttaggtttttccaaatataaaatcttatcatctgcaaacacagataatttgatttcttcctttccaatttcgatgtcctttatttctcctgtctgattgctctagctaggatttctagtactacgttaaataacagtggtaaaagtgggcatccttgtggtgtaccagattttagaggaaagaatgtcagtttttccccagtcagtatgatactagctgtgggtctctcatgtatggctttcatgatgttgaggtaggtttcttctatactcaatttttgagggttttttctatcttgagtggatgctgaactttatcaaatgctttttcagcatcaattgaaataacaatttttgcccttcattctgttgatgtgatgcattacattgattgatttgcatatggtaaaccatccttgcatcccagggataaatcctatttgtcatgaagtataatattttcatgtattgttgaattcaatttgttagtatttgttgaggatttttgcatcaatattcatcagagatactgccctgtagttctcttttttttgatgtgtctttatctggttttggtatcaggtaatactgggcttgtatactgagtttggaaatagtctctcctctatttttcggagtatttagagtagaattggtattaattcttttaaaaatatttggtaggattcagcactaaaacaatcagttcccaggcttttctaactgagagactttttattacaactttgatctcactgcttgttattggtctgttcaggccttagatttttttcctggtgcaatcttggtaggttgtatgtatctaggaatgtgtccatttcttctatattttccaatttattggcaaacagttgctcatagtagtcactaatgatcatttgaatttcttcagtatcacttgtaatgtctcctttttcatctctgattttatttatttgcatctactctcttttttccttagtctggctaaagatttgtctattttgtttaactttacaaaaaaatcaacattttattttatggatcttttcattgttttcttcatttcaatttcatttacttctgccttgacccattatttattttcttctattaattttggatttggtttgctcttgcttttctaattctttaagatgtattattaggtttttatttgaagtttgtctacttttttgatgtaggtttttatagctataaactttcctcttcatactgcttttgctatatctcataggttttggtatttttgaattttcattatcatttgcttcaagatatttttcaatttccttcttaatttcttccttgacctacttgtcagtgaagagcatattgcttaatttccatgtgtttttagagtttcccaaattccttttgttactcaattctaattttattccattgtggtcagagaagatgcttgatattttttcaacctttttgattgttttaagacttgttttgtaacagaatatatgatttatccttgagaatgattcatgtgctgaggaaaataatgtgtatgctacaactgttggatgaaatcttctctaaatatctatcagatccatttggtctatagtgcagattaagtccaatgtttctttgtttattttctgtctcaaagatttgttgaatgctgaaagtggggtgttaaagtgtccagctattattgtactgaagtgtatctctctttttagctctaataatatttgctttatgtatctgggtgctccagcatgggtgcatatatatttacaattgttatagaagagatcatcttgtagaattgaccccttacatagtgatcttctttgtttcttcttgtagttttggttttgaaatatattttgtctaaatatagctactcctgcgtgtttttggtttccattggcatggactatctttttacatccctgtatttttggtgtattcagtctaagtgtgtctttataagtgaagtgtgttgagctgttacctaagggcaagtctatgtccactttacttttccttctgcttttctcaagtgtaagtagacttgcctcataaacaccacagctgggaatgtgctgagcctcacctgaagctatcatgtcttaaaggttcacccaaagcctttgacataatacctgtgtaccactgctggttattcaaggcctgagggctgttcagttagcgggtgataaatgctgctagggctgggtcctttccttcaaggcagtgggttcccttctggtgtaaggtgtgtctagtagtgtttttctgggagcaagggtctgaaaaggaggcctcaggacactgaccagtttcccatcttgctgtggctgagctggtatccaagatgcaagacaaagtcctccccactcttccctcttctctcctcaagcagaaggaaggggtgtcttttggagctgtgaattgtgtagcctggggtcaggggaggggtgatgtcagcactcccttacccaccccagctggtgtctcagtaggttgtatgacccctgtccactagctctgggcccaggtcagcattaggcatttccttgatgttgcagtccttgtggcctagactgcctttcaaatttatttagagccccagagcacttagcccatggtggtgaggcttgcaagaactcaagtttgaatcacctggatagacaattcccctctggctagggtcagtttaaatgttccctccgtgggaggcaccaggtgagtttgatccagttttcctctctgctataacaggacagcactgagttcaatgcctcacaattgctgcattctccgtcctcccgcatgctgaaatactctgcgcaccatgccagtaccgctggggagtggggaatgggtggtgtcagggattcaagactattttttctacctctgcagtgcctcttttagggaaatgaagttaaaaccaggtactgcgagtgctcacctgatttttagttcttatgaaggtgcttttgtgtgtggaggtagttgttaaattggtgtctctgtgtgggggacaaacagtagagccttctatcccatcatcttgttttaactttttaaactgtaatatttttgttgagaattgcactatttagcattggaaagtttccttcttcctagatttgatcatttttttctggaatccaattgatctgagtttaagattacaacctctgccttctctttgcttgtatggtttcactggcataatttgttcacctctttctattcaagtttttctgaataactttcttgatttttttgtttcatatacagtatggaattggtcttgagaaaagatttaaattctttttctcagaaattaatccacttaaagtatttgtgtaacaaatatatcagtacgttttccatgtcattatttattgcatgctttctgtttttaaatgttttaaaaatctccagtcagtgacctgttaattgtgtgtgtgtgtttatatgtgtgttctagagtgggttggcgtagaggttatagtcttaaatagaaattttgaattattcttcagtgcagtgcactttctcagtagattattgcattttattaactttttctgcctattttcctaaaattctaactgaacttcactcacgtacaagttcatcctcatatattatgtttcagttttacatgttatttttattttatttacatatccaaagatggctttgtttctaatttttattcttcgggtttgcactgatttcccttgacagaaaaaaatacccatgagacttgaatgactcaattctcagtttgccacccattcctgttacagcatcagctttaacatgtctcttatatccttgctgcaatgcaaatttccttttacacctttatgaatttccagctactggaatgtcagtcttaataatactaatcatatagatgtatgcatctttcacgtatgttctttatcatctgaagtttccatgtaaccttttaaaaataaaagtgatcagaatgtactttgatagttgtataatattttataacccttctgtctttcttcctcattgtgataaacatctcttttgtataagcaaatccatcttaacagttttttatcaaactattgatgcttgtattgatgcatgcattaatgctttttcagccactttttatcttttatatgctgttatttttgagtgacagcaattcgcacttattaagttctgctacatataacagaaaattaaaaaattactgcggttttaaaaaaaaaaacagatgttgattttctctcatttaaaaatagttcagtgatatgatccagggatggcagcatcatggtgtcatcgaatgctctaggtcctcctaacttcctgtcccatcatcctcagtgtttagtgttcagtgtttagtcccagctgtaggctatagtaaggaagactgatgaagaggagctcctacttgtttattttagctccttttgagccctcttaatcagactatacctagtcgttacatttatctattgattgccaaaaatagtaacattgccacatccatatctagggttcatggagaaactggaaaatataggtttttaacattattactttttaaaaagtttccaaggagcctggctaaaatctaggtatttattaatgtgattattagtatataacttgtattctcattatattagtgataaatgcatgaagtattttcattattaattattttaatttggcaaataaattgtaaaagagaaagagagaagggatgagatagaaaaattaagatattccaaaaagtataaacaaaggagacagtctaatgcacatgtagaatttacaagtgtactgattttccattttggataacagtgagaggcgtgcctagaaagatgttttggatttcagttaaagaaatctactaatgtaaaaataccaaaacaataacttgatagcatactaaatagccctcagcttatcttcaaaatattatgcttatttatgcagtaggcatgcctaagattgttcttttattttcccattttcctaatagtatcactgtttttaatttagttgaattgtgttgtatgaaatacatgatttaatgttacaaagaaatactattcattgtctattcagaatagataacattttatcttttccagccaatgagatcaaataggacctaaggattttgcaaaagctaaaaaagaacaatagcgaagttgcctgctggctcaaaacactattttctattgcattattaaccttgttgacctaaaaaatgtgttgcataagttttggctaagaatttgaagttatatttttcacacacaaacagaaattttgagcccatttaataaaacggtaagttactaaatcctaacacagcaacttattgtctttaaatttacgtaggaaaacatttgcacctttttctttatgttatcgtgttattttgaaacccaatttttgacatatttccaaattaaacacaaatgactactatagagtaattgacatgtactgatatcagccagttttgtgtattaataattcagaataattgatttttatttaatgccatatagcctttttaaacccacatctgaaatgactatataacttatttgtattcccattcaaagatagctaaaacagcattaaaataagagtctggaaagaataagagttcacagtgcataatttcataatagaaggaattaatttagttttcaatacactgattttatatttcatattttaatccgtgtaattgattgattttatattttaatccgtgtaaattttattgaactagatatcttcacattaaattgtatttttttctcaataagaaaactaaaatataataatgaaaagaaaaatggtaatagttcatttcaaatgtccatgatgggctgggcatgctggttcccacctgtaatttcagtacttcgggaggctgaggcattgaatcatttgaggtcaggagttcaagaccagcctggacaacatggtgaaactccgtctgtactaaaagtacaaaaaaattagccaggtggtagtggcgcatgcctgtaatcccagctacatgggaggatgaggcaggagaatcgcttgggcctgggaggtggaggttgcagttagctgagatcgcgccactgcactccagtctgggccacagagtgagaccctgtttcaaaaaaataaaaaatctatgatggttcactgatagtttataatgtccactttcttccttagcattgataactaattaagagtgactaaaaaaaaagaaaagaaatagaaaataaacttgtttatggtgatggttctgatcattctatcagaaaatctcccctcgggatattagaaataaatattagttttactgaaataaaatgtagaatagtattcctgttgagaaatatattactacaatgtttatctccttttttatagaccattttatacttttacaaattatatttacatatttatttataattgaatgtgcatatttgtacatgatgtttcaactgtaatattaaaacaccattacatgattcgattatacttaaaaataaatcagaattagaggcacttccagaacagtagtatgaggagccttgtacagtctgtccgcgctgaaataacaactagtgaaaatgacaagaaaactaactcttcctggaaataggtcagtggacatacagcaaattgggaaatatttattcaaaaaaatctgctctgtcctagtaagaagagtgaggtctatggtatttgagttgcaacttggttccttccctttctctcctcagctcaggctgatggaagctataacactctaagcaggtgtggccggactacaaggctctctcacccatcagctcccagtttaaggcaatgattttttctccagaaggggccatctttcagcatttctcatccttcccacctgtcttgcatcagctccaggcaagtatggctaaaaggtctggcctctctttctccacccaggccgccattcccaaggcagaaactctaaccctgggcaagctgagaatattgggccatgattgcttccactccaacttgctcacagttcagtagttccatgtttagcgaggcaaacctagaagctatcacttccacacagctccctacttacatagctggagtctcatttcaaaataagtggtcagctgtccttgcctcaggtacccagaaataacttctctagggatcattccagcaggtgaaacagaccataagaccagagagctccatggatctctctaaggtgactggtttcgtttagaacagagattgcggaagttcaaatctaaggaaaatgtctaaaacaatggatatttttgtggtgagcaattaagaaggggctaatggcttcaatgtaggaaaaagcaaaagtgtagagcagctaaaagttaacaaagaaaaacagggaaacagagataaaaatactcctgggattgggaaaactctgaaatattgatttcaaagacaaccctctcaaaggagtctaactttaattacatcatactgtggagcaatttatgcccaagggaaatgtcaaaacaatggagtaatcagccagcagttagtgaaggttagcagctgggtgtaattctgatgcaggtagaccagctagaaacaaaaaggagtacagagaatgaaagagtcaaaatgaccttaattaaacccatcatccatcccttggtgaggaggatcaaggttactgtgcatatgctcagagctgcgcactcttggggtgacattagagggtgcacaacgtagggaaaataaatttcacagaactagcccagctgagtcactaagcaaataaataagcaagcacacagcagcaactctaagttggggtgggagatttataacaagttgctacaatatattacttaaaatatcaaattttaacacaatttaggagatatgaaaattttggaaaggatgacagctcccccacagaagcatacacacccacccacaacaaaacaaaatgaacaaatacacaaatgactctgtccttgaaagggctcaaaggttggatttaacagacacatttctcaaagcagctattataagtatgttcaaagaactaaaagaaataattaagaattaaaggtaggtatgatgatgagctcaaaagtaaaaataatattaataaacagaatttatacaaaatcaataaaaattttggacacgaaacatataattagtaaaattttttaaaaatcatgagagggcctcagtaaaacacttgagcaaaaaaataagatcaggaaatttgaagataagaagatagattatgtaatatgaagtagggagagaaaacagaatgaagaaaaatgaacacaggcacaaagaaatatgggatacctttaagcacaccaacacacatacaatgggagtaccaaaagacaggagaaaaaataacagataaaaatatttttaaagtgggttaaatacttctcaaatttgatgaaaaatattaatttaacacatctaagaaactcaataaagcataagtataataaatagaaaaagaaaagaattaaagcccagacaaatcaggaaaagcatattgaaaaataaagagaaaatcatgaaagcaaccagagaaaaatgatccataaagtacaaggaagttcaataagataaatagctgacttctcatgagaaataatagaggtcagaaagcagagagatgacatattcaaagttctgagagaaaaaaaagtagtcaaagaagaaacttagattcagcaaaattctttcaaaaatgaagtaaaaaatggagacatcacccaaaaagcacaaactaaaaaaaaatattgctatcacaccaccttacaaaaaataagaaagaaaggtcttcttgatgatatcaggggttaccagaggataattcaaatacgcacacaaaaatgagtactagaaaagtacttatttaagacactgcaatagacagcataattagatatttctccctttttctattatgtaatttaaaaagcatttgaataaagctatgtatataattgcattgttaggcctataacatgtggcagtgtaacatatttgacagtaatagcataaagaaagcaagaatgaaagggaggatgctactatcaaccttgctgaaaaaaaagagaattacaaaaaatatgaaaagatgtatgacagcattattaatctagacaaaatgaataaattcttagatataaactactgaaactgatgcaaaaagaaatagaaaatcagaatagacttataacaagtagctaagtaaatgaagccacaagaatccaaatgtaatgtataaaattggcaaatttatagagacaaaaagtagattagtgattacctaacatgatggggatgaggaggtggtcaatggagaatgacaatttaatgtgtgaaagtcttctttttaggatgaagaaatattctaaaaattagactgtggtaacagttgcacggctctatgtatatacctcaaataattggtttttatacttcaagtagctaaattgtgtgatacatgaattgtttctcaataaatgtatttaaaagattagcacattgatttttagtatcttttaatttttagtaacttttaataataagtttatactctttgtacatttcagacaaataatataatttccattcttcttaataggggagaaaaggttaaaaaaaggatctcaaagaaaagtgaaaacttcatacaaatgcagaaactattacttttctaaataatttcttaaagtagctaatttttctagtacttttggtaccacaatatcacatgttttaaataaattcaaggttgaattttcttttaaaaagtctagggaataaaagcaaaagactttcacttagtctttcagaaatatttttatttttactttgttgtttgcttcacattctctgaatattgatgttgcatttgttttgattaaaaacaaaccagattttttgtatgagaaaaatatatctcaatttgtttatgcagtattaggtaggaattttgtgttttgctttaaaaaatcaattcaaacttctacaatataatagacatgaaagagaattttcttgaatctgcatctatatatgatctggctaatgtctcatttcccgttaagcttattttaaccaactggaattatttcattagatagtatcaatattacaaaaatctaaagtttcaacacatgcaagtaaagaaaattcagatatgttaaagtattgctaacatctaacaaaataatttcaatttgttgaaataggctgaatccttgggattccattttttaaactaaaaactttagacaaattaaatttaacagagtttatttgaacaaaaaaaaaatttatgaattgggtagcactcagtgccaggaaaggttgagagctccaaccagcaatgtaaacaggaagtatttacatacagaaaaaaataactgacataagtaaacagcttgattgattacagccaggtgttagccatatttgggcatggtgtgatgaggcatttgccttatacgaatatagaatgatcacttggcagcctttgattggtggaaatttggctgctgggattgtttgggactcaactacttatttacaagaagattctcttaagttacgttgctgtttgctctataaagattcaaaatacagagtcagcttcagaccaaatttaaattaatttaaaagtttatgctataaataagaataaatgtctcagagaattcagatacatacattaataacataacatatataaataaattgatgtttgttctaacataaattctttaaaagtatataatttatgcatttaacctacctttatatctaaacaattttatcctattgcttttctctactacttgtaatatgtctttggttgaaaaaggataagtaaatacatttgcataatgatatataaatttgtctttgaatgttcatttgctagtcacattattcatattttagttttaatactataagagcatacaaaagcaaatcctctatgttgtcattctcttagttgatatgctaaaatgcaaaaagaatcatagaacattagaaactaatcctactccactgaagctttaagattagaaataataagcacaaaaggtaaggctatcccatagcatactaattaccatagttaataaacagtttctgtacagtaggccaattgggtcttggcaaaaaggctgctatatctcttattattaacactcatatctttacaatgaatatagctacatgactaaaaattccttttttccagattcccatgcatcctattgtagccataaaaataaattctgacaattaggatgtaacaggaactgatgagatttaaaatgtaatatgacaattttatcacatcatttataaagaagaggcttggctttctttgaaattttgtccctcatgcagcctgaaatgcaaacaatgtatctgaaactcaaggagccatcctggatcagggggactaagactacacagtaaagaaatgacctagaaagaggtgaaatccacaatgaattcataaagctgcctatcagccctggcaagcctccttgaacttctactgggaaaaaaatcaactttttaaaaccaattctttgcaggattaatagcctggatttctaactgataaatgctgaagcataagcaatcagagggctcagctcacctgtttcctgcctcttggagaacattatcctttgtagccttatgtacagtgtcttttaaaccattgtttgatacattttgctgaattctgcttaattcaggtgggagggtaaatcctgttccttttattttatctttgccagaagtagaaatgtccaagcatgttgattaaccacaacttcatttaaaaaaaaaagtctgacttactaataacactttctatcagcaagtgaatggtttggttagacaggttttacatatttatgaagtaaattattcataagcaaaaactaaaaagcggcacataacaacatggatgaatcatgaaataattatgctgagtatggaaaaacagattctgcagattttattctgaattattccacctgtaagaaaactaaaaaatgaaaatctaacatctaattgagaggtgacagcgtgctggcagccctcactagctctcggggcctcctcagcctaggcacccactctggccacgcttgaggagcccttcagcctgccgctgcactgtgggagcccctttctgggctggccgaggccggagccagctccctcagcttgcggggaggtgtggagggagaggtgcgggtgggaaccagggctgcatgtggcgcttgagggctggcgcgagttccaggtgggcgtgggcttggtgcgccccgcacctggagcagccggctggcgccagtggtcccaggcagtgaggggcttagcaccagggtcagcagctgcggagggtgcaccgggtcctccggcagtgccggcccgctggcactgcactggaattctcaccaggcgtcagctgcctccccatggtgcagggctcaggacctgcagcctgccatgcctcagcctccccctccaccactgtgggctccttcatggccagagcctccccagtgagtgctgccccctgctccgcggtgccctgtcccattgaccgcccaagggctgaggagtgcaggcgtagggcgtgggactggcgggcagctctgcctgcagcccaggtgcgggatccattaggtgaagcctgctgggctcctgagtctagtggggacttggagaatctttatgtctagctaagggattgtggatgcaccaatcagcactctgtgtctagctcaaggttgataaacacaccaatcagcaccctgtgtctagctcaaggtttgtaaatgcaccaatcagtgctctgtgtctagctgatctggtggggacttggagaacctttacgtctagctaagggactgtgaatgcaccaatcagcactctgtgtctagctcagggtttgtaaatgtaccaatcagcaccctgtgtctagctcagggtttgtgaatgcaccaatcagtgctctgtgtctagctaatctagtggggacatggagaacttttgtgtctagctcagggattgtaaatgcaccaatcagcaccctgtcaaaacggaccaatcagctctctgtaaaatggaccaatcagcaggatgtgggtggggccagataagggaataaaagcaggctgcgtgagccagcagtggcaacccactcaggtccccttccacagtgtggaaggtttgttctttcactctttgcaataaatcttgctgctgctcactctttgggtccacactgtctttatgagctgtaacactcactgcaaaggtctgcagcttctctcatgaggccagcgagaccacgaaaccacccggaggaatgaacaactccagatgtgccgccttaagaatggtaacactcaccgtgaaggtctgcagcttcactcctgaagccagcaagaccacaaaaccaccagaaggaagaaactctgaacacacccgaacatcagaaggaacaaactctggacacgccacctttaagaactgtaacactcaccacgagggtccgcagcttcattcttgaagtcagtgagaccaagaacccaccaattctggagacataatgataaaaaagcaaaccagagatttactggaaccaaagaaggtaaagttgaggacagagaaaattttggagacaacagaaatgctcaacatctgaatagggatggttgttacgtgattgcagacatttgtcaaaactcatcaaattgtacacttgaatttgttttaatgtgccactttgctttgtcttttaaagtaattaaaaacgttttaaaaagactttaatatttactgtcatgtttacttttctaaggctcttcattccattggctggatccaaatatcatctgatatcatttccctatgtctagggcattttcatttctatttctacacacatctactctacctattacccttcctgtctccaaatgaaatgctggaggacagcaagggagaagcagagaccttctggagcacactcaagatggctgcacagagatggcggggaaacaccttgccttttccaccatatcccccagctggggtcatctctgaaccaggagggactactccctataggggaaggtaagcgggagtcactcaggcggctgaggcagaagaatcacttgaacctgggaggcagaggttgcagtgagccgagatcacaccactgcactccagcctgggtgacagagcgaaactccgtcaaaaaaaaaaaaaaaaaggcaggagtctcccaagggctcccattacctctgcaatgtggggcccacattgttccccacttctcataccccaacctgctactgcacaagttattttgaaatcagagccacggctacaatgtatcctgctttgggagccagtaaccactgcatcccttcatccctgaggttctgctatcattgcaccttgctcacacactggagtgtgctattccccagcagaatagctacagcttcctacgtcctggtgctaaactgccttacatgcacttcatctccactaacgcagttgtggcagtcccctaaccccagctgcttagagcctagtaccagtggaacatggactctgcttccccattcctgcctgaaccagctcagtgcctagccccctcgaaatcagagccccagtccagcagagcaactgcctatttgggacccaagcccatgtagtgccctgacccctgtagaccagggcatagcagcccagaagtgtagctgtaccctttggatcctgagaagatctgcacattgcctcttgggagactaggagtgccatcccagagaagcagctgtgccatccaactttgaacttacatgttcaccatcattcagggtccaagagtcctgaaacacaatagcagccatagcccctgaagcttgagctaactggtgtcccatccccctggggaaaaggggatcaagtccaacagaacacttttgccctcagttgctcaagctgatgcagtctggccccacagatacagacagccttagataagctctgccaccctatcctctaggctgaacaatcccaatgtgctctgctttcatggatctagactaatcctccagggtttcagctactaaggtgttccatctctctgaagagtggagtcatcattgtgctgcaccatggcccctggtgccaaaacaatagctgtgccccataatactagggtcctagctgccactgtacccaacgacacagaggctggaccactgctatgtcccactacctcagggtccagaatatccactacatggaacctcctctcctggtgcccacattgtctctgtgccctgttggcctcaggtcctgaattgcatctgagcttctgaaacaccacttcttccttggactggtgcccatgctgtgccctcaaaatcagagtcatgctacattccacctctcagggttgagctcatggcctgtgcctcagagtcagaatcctaagctttgtagaagagctgtatccactcatttctgagagtgaaactgaacccacatcacagtagtcacagtttaccagaaaagggagcccaggacccagctccacagccattttgaacacttgtgccctagaacacagggcttctgtggctgcatgtgggctgtgtcagacccaataccaagagggaatctccccaactaagaccctgctgtgagggaaatgagaacaggaaccctaaagccctttccaccaagactcataacaacttatgctgccaccaccattgccacaaacttttatggcctaggccactaaagttcctgcagttatcactaaatttgaccaccgctgaagaagctacatggagactatgctactgtacccactcagaaccagagccaacactccaccaacactctaagacccacctgcatgtggaagtcttttcctccaaaaggcactttataaatttaggaaaaagtaacagttccaccagatgcgcaggcttcagtgaaaggatacaagaaataggaaaaagcaagaaaacttgatattaccagaagaaaaaaacaagcaaacaaacaaaagacagaaattctccagtaactaatcccaaagaaagagaaatttatgaactgtctgaaaatgaatccaaaataatgttattcagaaaactcagtgatatactggagaatacagattgataattcaataaaatcaagaaacaattcatgatgttagtgagaaaatcaagaaagaaatagatatcataaaaaagaacaaaacagaaatcatgggagctgaataattcaatgaataatgtaaaaaaagacaatagagacctttagcagcacactggatccagcagaagacataatccataaaattggaaacgtatcttttgaaatagcctagtcagaggaaaaaagaaaataatgaaaagagtgaagaaagcatacaggacttaagggatactgttaagtgaacatatattcacactgtggaaattaaagaagatatcaaaagacagtcaggctcatgcctgtaatcccagcactttgggaggctgaggcaggtggatcatctgaggtcaggagttccagaccagcctaaccaacattatgaaccacccccatctctactaaaaaaaatacaaaagattagctgagcttggtgatgcttgcctgtagtcccagctactcaggaggctgaggcaagagagtcagttgaacccaggaggtggaggttgcagtgagccaagactgtgccactgcaatccagcctgggtgacagagtgagattccatctaaaaaaaaaagacaaggaattttttaaaaagcaagaaaaatggatcaaataatatacaagagaagcctcatgaaattgtcagcgctaacctcagaagaaatcttataggtcaggagaaaaatgggataacatactcagaatcctaaaagaaaaaaaaactgccagccattttatcccatacaagcagaagctgagggaattcatcatccctagacctgccttaaaagaaatgcttatagcagctcaaccagaaacagaaagatgataatcagtatcatgaaaacacatgaaagtataaaacacactggcagaggtaaatacatagtcaaattaagaatatggtattactgcaatgacagtgtgtaaacttttaaaatctctggtatgaccactaaaagttaaaatggtcaaaaatatagttataataagttgttaagaagcatgctatataaaaagagacaatgataaaaatataaattgtggagagaggataaaagtctgaagtatatttatgtgactgatattaaatttttgtcagtttaatatagtcaattataactataaaatgttttacgtaagcctcatggaaaccacaaagcaaaaagttacagaggatacacaaacgagaaagaaaaaggaatcaaagcttagcagtacagaaaaacaccaaaccacaaaggtaggcaacaagagaggaaggaacaaaggatctagtaaacagccagaaaacaattaagaaaatgtcaggagtaagtccttacctataaataataatcttgcatataatggattaaattttccaaaagatgtaaagtggcttaatggataaaataaatggaatccaacaatatgttgcctacaagacaccctatttaagctttaaggacccgtatgggctgaaagtgaagaaatggaagaaacgctattctgagcaaatagcaaccaaaagagagcatggtggctatacttacatcagataaaatagaattcaagtcaaacactctcataagagacaaaaaaggtcattacttaatgacaaatgggtcaattcatcaaaaggacacagcaattgctaatatatatggaccgaacatcagagcacctaaatataaaaaccaaatattaatggacattaaaggagaaagagatagcaatataataatattagaggatgttagtaccctgtttgaaagaatgaatatattgcacaaaaatttaataaggaaatattgggcttgatctgcactttagaacaaatggacctaacaaacatatatagaattttccatccaacagcagcagaatttatactcttctctagcgtacatattaggctgttgcaaaagtaactgtggttcttgccatttaaagtaatggcaaatgtaacaattacttttgcaccaacctaatagaacactctccaggatcgaccatatgataggccacaaagctaatcttaacaaattcaagaagactgaaataatatttagtactgactgaccacaatagtataaaaccagaaatgagtaccaggaggaatcttggaatattcacaaatatgtggatattaaacaacatgctcctgaatgaccaagggtcaaagcagaaatcaaagggaaatttccaaatatcttcaaaataatgccaatcatataggttttgacacaacatatcaaaacctatggaatgcagaacaagttccaagagggaagtttaagtgcctacattaaaaaagaagaaaaattcctaacgaacagcttaaccttatgcttcaatgagctaaagaacaaattaaacctaatgttagcaaaaaaggaaatgataaagatcagaactgaaataaatcaaatggtgaccaaatcagccattgaaaaacaatcaataaaaccaaaattggctctttgaaaaaaataagcaaagtgacaaatccctagttagaaaaaaagaagacttagtaaataaaatcagaaatgaaagtggagacattacaacagatgtcttccaaattaaaggattataagggaacgttatgagcaattttattccaacaaattgaataacctagaggaaatggataaatcatagagaaaaataacctaccatgataggatcaagaagaaaaagaaagtttaaacattccaataacaaagagattgaagcagtaattaaaaacctgccaacaaagaaaagccaaggattagacagcttcatggctgaattcttcaaatattcaaagagaaattattactaatacttcacaatctcttccaaaaaacagactgagaagtatttccaaacactttttacaaggccagcatcaccttgatgtttatgtctgacaatgatgctggaaaaaaaaagaaaactataggacaaatatctctaataaacatcaattttaaaatcctgagtaaaatattggcaaactaaattcaacaaaacattaaaaatattgtacatcatgaccagatgggatttatccctggcatgcaaagctgttttgacaggcaaattaatcaatgtgatccatcacattaacacaatgaaatataaaatccacatgatcatctcaattgacacataaaaggcatttgacaaagttgcatttcctttcttaacaaaaagtaacagttttaagtatagaaggaatattaggaatattattcagcctaattaaagaatgagatcctgccatttgccactacacggatggaactggaggatattacacaaagtgaaataagccagacacggagagaaaaatattgaatgatctcacttgcatatagaatctaaagaaaataaaagttcacacacatagagatagagaataaaacagtggttaccagggcggagttacgggaaaggaaatggtgagatgtaggtcaaattagacaaaatagcaggtatgatacacgtactatgtacccacgcaatttttcttaaaaaaaacaaagtagtaaatatgtaaaatgaacaagtctagaactctcatgcacacatgaacactagagttaataaaatcagattgtattaggattattgttaaataagattttagctgcttctttcataaaggtaactatgtgagatgagatacattataatttacctcactacattaatcattttactactatatgtgtctcataacatcatgttgtaaacctcaactatgcaaaataaaatttattttgtaaaaaagaaattatatcagcaaattaaatgttataaccgtcagggacagtaagctggttctacagagactagattactggggagtttcatgtataggaaaaatctgacatctgtaggaaactgactcagaatctatttgaactattgtccctaagagtaggaaacaggaactattgacttgatcatctgaatttgactagattaatccagatttgtcataaacgtaaattttatgaaactcgatttagaatttttcaccctgttctattattccaaggaagtaatttacattaaaatctctcatatactcaagaaaaatgaattacttttatgtcatcattttcacctatgcattctaaaaataaatcagatacaatattccatacattaatttcacttcatttttaaatttctgtgacaattttgactgatcataaatgtgagcctttttttccacccagtttgtctaatataggatttttaaaacacacagaaatgcatgcctacaaaatgagaataagtaacattatacatcttgaatgcatatgtatatatgtatatgtattagtcgttctcacacggctacaaagaactacctgagactgggtaatttattaagaaaagaagtttgacaaagagttccacaggcttaacaggaagcatgacagtgaggcctcaggaaacttacaatcatggtggaaggtgaaggggaagcaagcatgtcttaccatggtggagccaatggatggggagattgagggagtgccacacacttttaaatgatcagatctcattagaactcactcactatcatgagaacagtgaaggggaaatccatccatgaccaaatcacctcccaccaggcccctcttccaattagacatgagatttggttggggacacaaatccaaaccatttcaatatataatactcatatttgtatttatgaaatgaccattttattgacatagtaatcaaatgtgtgtgtttctgatgcatagactgtatacattttgtaataaacagatgaatccttgtatgtgcattaatataaaaaaattactccataataatcagacccttataatattatgtcaacaccagtaagttctctacctacatttcataattgattgcattaatgtgacaaaaactaaacagaatttattgattattgtgtatatatttgtcaagggaatattaatctattcattaaccagcaagacgttatgaccttaagcaccactgggtattttcttctttctctgttaaaatatcattctgatcctacatttattgcaggaatttatctgctgtattcagtttactttattttttaactcataatcatggtacatgaaatactatgtcactggctcatgaattatctttatttatatcacttaatttattaaagttacaattaatctaatccccaatttgagaactattacttcataaacgactggcatctttcattgtgtctctttcatattacaactccaattctctcacaggaattgtcctgtaaagaatttgtgtttaatatttctcttcccattttcaaagtttagtaacatatgcattcatctctaaacaataaattggtttagtattttattattgaacttttaaaaaacatatatgagattattgattattttcattaaggtaagcaacattaaaacttgtatgtggccgtgcgtggtggctcacacctgtaatcccagcactttgagaggctgcggcaggtggatcacgaggtcaggagatcgaaaccaccctggccaagatggtgaaaccccatctctattaaaaataaaaaaattagctggatgtggtgggacgcaatgtagtcccagctactcgggaggctgaggcaggagaatcgcttgaatgcgggaggcggaggttgcagtgagccgagattgtgccactacactccagtctggtgacagtgagactacatctcaaaacaacaacaacaacaacaacaacaacaacaacaacaacttttatataacattctgggcttctttttaattcagtattatcaacttttattgtatcccttctcctgcacatgaattttcaattattttcctccagatgttgctattatgacctatggtactataaaagtattatctccttgtatgcatgtgctaagtttctcttaggtatctatgatatcagcccactgctgtgtcatgaatgaatgtcaaaactcaatggcacaggaaactaggccttcattatcaggattacagttctttctctatggtccccttagggggaccatacaagggtagtgtcataccacttgtgtctaattatcctaggaaagaaagttatgcagattgtatttttatgatgatagtggaagctccattgtgcaagtacatttcaatccttcaatcatgttatatccattaacataggtttacccaaacctaaagttgacatcattagaatgaggaaggatatcctgcctacaattggagagacaggaaagtgaaaattttgaaaactaatccaaactatcaccaagtcctagcagtagtatgattatatcatactgtatgtgaatattgtgtcttacacttcaatgtctaattgttttccagagtggttacatcaaattatattcccacccattgattctgtatgatatcgcattgattctcattctattctacacttcctctattaaaattttaatttttaaccttgaaatgggaattaaatgaatgtcattatattatttattttcatttcattgacctttaatattaaattacttggatgtatatgtgttgtctgctgtaaaatattaacttatctgttttacgtagtttctatgtattgcttgttttaatcttatatgtctacgtaggtctatgatccatttcaagttgacttttatgtaagatgagaagttttgagtctaaattcatctttttgcacgtggaatcaaatagtctctaaacaatttgttggtaggactcttcttttgcaaataaattgccttggtgttattgttgaaaatcaaactgccataaatgaaagggttcatttctttatttttattttcaactctatctcattggtctatatgtctataacttgtaccagtaccacaatgtcttgattactgagtggcaacagtgttgaagaaaacctgctgaaattttgatagggtttccattgaatctataaatcagatttgtagtagcatttaaattcttaaagtttaggtcttccactttctttaaatgttaagattgcttggctattagcagtatttcacattttcatagaaattttaaaaatagttggtcaatttatgcaagagggagaagaaagagaaagaaggagaaggggaaggggaagggaaagaagaaatagaagaagaaaagaggaagaagaagcggaagaagaagaaggaggaggagaggaaggaggagaagaggaggaggagggagaagggagaggggagggaggaggagggagaagggagaggggagggaggagggagaagggagaggggagggaggaggagggagaagggagaggggagggaggagggagaagggagaggggagggaagaggagggagaaatgagtagggagaagggaggagtgggagggggaggggagggggaaggagagaaggagaaggagaaagaagaaagaagaaaaggaggacgatgagaagggagaggaggtggcaacaatggcgaagaaaaacctgctgcagttttgatagggttttcattgaatctgtcaatcagtttggggatgataaccttcatcataatatggagttttccaatctgtaaaaatatattatctcttttatttaaaccctctttcatttgtttcagcttcttttttaagttttcaatgtgcaaactttatgagacttttgtaaaatcatccttaaatatttcattatttttgatgctactgtgaatggaactgtcttagtttcatttttggattgtttttactatacagagatacaactaatttttgtacattggttaactttgcagaataaaagaccgatgtacaaaaattagttgtatctctgtatagtataaacaatccaaaaatgaaatcacaagttatatgaagtgtgactttattagttctagtagttgttgcttttgtgtgtgactctcttcagattttctgcattcagtattatttaatgagtcaatagagttttacttattccttttgaatctgaataactgcatttcactttcttgcctgattacactacaaaacttttaatacaaaattgaatgtatgtgatgaaaatggatatctctgcactgtttctgatctaaagaagtattcactcttttaagttattcataggattgttttatttaaataccttttatcacactgaggaaatgcacttctattccaaaaatgttgagcatattttttctaatcactaatgggtgttggattttgtcaaatgatttttctgcatctgtctgttgagatgataatgtattgctctgtcatttaatttatattatgatgtatttcattaattcatttttggatattaagtcttcctggcatatatcacataaatccacttattcaaaaaagatattcccccctcaccatttctagaaatacttgtgaaaatttggtcttattatttttctaaatgtttcacagaattatggtactaggattttctttgtggaaacatttttaaaaactaattcaatttcttgttagattttccatttttccttaagtcaattttagcaactcatatccttttagaatttttctatttcatatagctatttcatatataatttgtttatgcacactttttgtaaacttttaaaagaagctttttttgtttgggtttttctatagtttttctgttttatcgatttcacctctagtaattatttttatttatttctgtttgctttgggtttagtttgttattcttttcttgtttcttaatgtcgacacttaggttattgacatgagatctttcttcttttctaatataggcagttaattataaatatctccaatattatgcagacatgcagttacgtggtgtcaaaaacagcatacaaaatagttgtttgcttaaggttagagttatagtctaattttcacagaattcaaagggaattaattgttcattagtgccttccatcccttattcatgttacctcttttcaatttgcaatttacaatctcctctctaccaaaataaattcaaggcagcttcacttggctatgataatttaaaaaatcatatccctgttctttgggggttatcgtctcttaattcagactatttttcttctcatgaagctacatatatatttcaattattcatttccatattgttatagttgggatggacagaggggggagtgaggtaatcatattggaacttatgtgtggaacatttgcaaaaaaatgagactatttacactgaaaattagcatgcttttagccagtttttttacattttatgagaaaaatgtctctctcatcaattaattgtgagtacatttcccggggtctcctttagtaatccgggctgctacttcaaagggaaaaaaaagcaatagaattttgaagcctttggatgagaaatagtaatatgagtaccaaaaaagctatttttttacttaataatattatttgttatttgaaactctatatgaaacatgtatcgtatgacccctacatatagtgatattttataaaaagttactacaacaaaatgcccaataagttcttcaattaaatattgctctatgcatacttagttctatggactgcacctgatatggaaacaccaaggtataattctaattaagaaagtaaagaacaacaaatatgttggatattataactctagctcagtaatttttaaataatacttttttctttctatatgcattcaaaaattcctctagtatttacatgtcaaagggggttgaaattaagtacaaatatcttaaattgttaaacttttcctaatattaagagattttatggttgaacatcagaggttgatggatatacttggctatgacaagattatgtaagatttttatatgcaaaataccaaatgccagatgttctttatctctgttagatgaaaaacaaatacaaatgaggtcaagtactcaatgtgcatagtgtgacatttaaaaatatttctatcacacatcttgttttcagtaacattttaaacctgtcagtggataaaattaaacggcactcccaaacatgtcattaaattaaaacctgaaaagagactactcatttaattatctgatcttaaatttctgacagtgaaaagaggattacatcaatgtttaaaattcaaggggaaagaaaggaaattatattggcagggctctgaaacatgacttaaatttcatgagtttagatgtttgtaataactattcatctatgatataaatgagataagcttatattgacttgtgcattctcaggagaaaaattaaaaatgtgtatctttaagcaagtaaagaacaaagcctgttttacataatgatatactggcgacagctgcatgacagtctagaagaaataaggctatggtaggcaatgattcatcataaaaataactgttataaaatcatttgcaaacaaaatcattataaaactaaccacatctttcattatctgccaagtttttgtaattgttaaattatactaatccggtggatgacagactcatcaataatggagaaacttcataaattaaacaagaaaaaaaactttgtagaaattacagtaaaagtaaaattattactggctgccaagaatttaagatctattcttacacagtatgataggtaccatatgctgattatttataattatttgaacattactgagaatgcttgacttcttttactggtgaaaacacttgtttgttttcaggatttcaaaagtgaacagtggagtgatatccaattcaatagtagttggaaaaacagagatttgacccgaagtttctagatttaaaaactatagaaataatttttcaagtgagacatattatcactatctaatcatttcattatgggcctcaaaaattttgtttactcaacaactactttcagcttttttatgctagacactgatcaaagcttagacaaaacagtgaataaacagacaaaattacttgccttaaagaggcttatattctagtaggaaaagagaacaaaaaacaacacaaaaataaaataaaatatataaaagttggattgttacaaatcctaatgaaaaaatatataagccagagaaagttttgagttgggatgtgggctgcaattttcattagagtaaccagagaaagattccctaagaaagaggttttgagcaaaatctgaaagagttaagataatttccagtaattttacccagaaaaagaactctagaatgaggaaagagcaagtacaatactctgagatgagagtaggcttctatttctgaaaaacagaaaagaggtaactggttacagaaaaatgaagaacaggtaaatatgtaggagaaaggaggcagatataggagggggacacaaatcatataaggtccttagttctaattatgaataagataggaattcaatggaggttttacagcaaaatagcgacatagtttgacacgtctcacaagaatcacttgaatttatcagttgagtgtaaactatagagaaaaaggacaaaaacagaaataacaaataatagacaataagccactcagagataaaaggggtttggaccaggctagtagaaatgtaagtggtaaaaaatgcttgaattattattattattattttttgtttttgagatggagtctcgctctgttgcccaggctggagtgcagtggcatgatctcagctcactgcagcctccaccttttgggttcaagcaattctcctgcttcagccccaagtaactgggattacaggcgcccaccaccaagcccagctaatttttgtatttttagtagagacggggtttcaccatgttggccaggatggtcttgaactcctgacctcaggtgatccgtccacttcggcctcccaaattgctgggattacaggcatgagccactgtgccctgcctgaattctaaatataatttgaaggtactaccaacagaatttactgagtgattggctcagaagagtgaaagaaacaagaatcaataacaaattcaaggtatttggcctatgaaactagaatggagttgccattttttgagtaaaaaaatcaaagaaatatagtggatttgagggaaataggaatttgtttatggatatccttaagtagtaatggtgattaaaattgggcatattgaatcagcatacataaaaatatgaagctcagataaaaggcccaggttgtcagtatacatttgagcatccgtttgaatcagctttattattacttaggtatgataaggctagcagaccaggaaattactgcccttaaaaagatagtttatgatactccaagtccccgagagagaaaacacgtcgcaccgtgaggcactacacgggaaagcactggtgtcagtcatgaggcagagagggaagaaagaactgtggacaagagcctttattttggtttccactgaaagaaacaggtgaagcagggtaaacggtcttataattgggtgttttgagaaacttcaacaggctctggagcataggggctgtgcctggttgtctggcacttgggcctggggtgattagggcagatttttagtgacctgaagcatgaaatctcaataagtgaagtaggtgggagtgtagacttggattgcttggtctgtttttgaaaagttcaccgtcaggagaaggactattctcaagtaggaggaatgaagaaggaggcaggaagctaaaatgaatctggtactatcaggttgtccagagcaagatgtatctagcatatgtatgcaggggagacactaaaaatcaaatatacagaaacttgaagaaatatgatgaatataaagttgtcactgataggtggtatttgaatccatgattatgaatgagatctttaaggcaggcataaaaagcaaagtatttagaatgaattggtcaacaggtagaataaaatgcattaggagtatcctaggactctagtaaaaaaaattttttttcaaagaaaaggtaatgatttatttgtcaaatgttgtctgagaagaaaaaaggaggtaaggactgagaccagatcattttatttaaaatgttgttaataaattacataactaaaaacagcttcagagataagcagcagagtagatatcaaaatttttcaggatttcaaaagtgaacagtggagtgatatccacaaatatggcagggtaaggtaactgaaaattctctgcttctcaataagctgacaaaaatgatacatattgtcaaaataaatgtttcagaaatgtagatattaactgaaggcttgcagcaacctggaacagttgttcccataatgctggctgaatccaggccagaataacaagttttgcattattttaacttgcccaattcccatctccccctctctaactcttcagcagtcttaagaaagaaagaaagaaagaaagaaagaataaaaggtaaaaccagcagcctgatagccattagaggggacataatgtggttggaacagtgctcttacaccttattcttaaataactgacattatttgaactacctggtggatcctggaagatccctcttatgaggctgtctttattttgacctgacttgggtctcctaagctgaaaaagtctcttccctggaaatgttggttgaaaacaacttgaaggaaatttcttgacttcacagctgcctaagaaaatggataacagctgaagaaagcaaaagcagaagcaaaatatttaaagaaaaatataggaacatgtccattagaacttagaaaagctaaaaaactcctgggaatgtaaaagaccacacacgtgtggggctgagggcatggtcaagaaaaacctgagaaggacataatttctcacctccagttgatcttgaggctcttcaatagcagaaagtgccagcaatgcccagccacgcttgccacccaagggccttgggactgtgccaaccaggccaccaccactatcactggtacccacgagcacctactgccaccactgaagccaaggatgccacctagtggcccgaggaccagcctgcctgggtccaccatgttggactcatgtatgtcacccagaggccccaaaacaggcacacttggcccattttggccaccactggtgcctgaggaccaaactacctggcatccccatccccagaaaaccctcaccagagcctctactaacaaccgcagcccaagtaactgaacacagacaccactgatactgattatacccaaagaaataaggaagagaatatactactttacccacctggaatcaaagcaaaagcatgctaccaaatcttcatcatagttacatttatagggaaagtctttctctatgaaagcaaatctataaaattcaaagaagacactgttaaatcagatgcacagattatcaaggtaaggacacaagaaacatgaaaaaacaagaaaacatgacaccaccaaacgaaaacaataattctccagtaacagattttaaagaaaaagaaatctataaaaatgactggaaatcattcaaaacaatcttataaaggaagttcagtgagatacaagagaacacacacaaaaaatcaagaaaatcagaaaagcaatacacaatatgaatgagaagttcaacgaagagactgatatcatacaaaaaggcaaacagaagtcctgaagctgaaaatttcaatgaatgaaataaaaaatataattgagagctttaacaataaactagataaagcagaagaaagaatttataaaggtgaagacagaccttttaaaacaacccagtcaggcaaaaacaaagaataagaggcaataaagaaagcctacatgacaaataggataccataagatgacaaaatattcaaaatattcaaattttgggatttatagatatatgaagagataggggaaggcataaaaaacatatgtcatgaaataatagctgaaaacttcccaagtcttgcaagagatacagacttacagatacaagataattaaatacagtcaacccaaaaatattcaaacaaaaagggtttactctaaggcacattatagccaaagacaaagagagctttaaacacatcaagtgaaaaatgttaagtcacatataagggaatccccattagactaacagtgcatttctacagaaaccttataggccatgaaacaatgtgttgaagtcttcaaagtactgagagaaaaaaaaaaactgccattcaaaactacttcactcagaaaaactaacttcagtaatgaaggagaaataaagtatttcccatacaagcaaaaactgagagaattcatcaccagtagatcagccgtccaagaaatgcaaagagattcgaatatctggaagtaaaaggatgatatctaccatcaggaaaacacatgaaagtatacaactcactagtagagtaggtacacaaatgagaagagatgtcaaaagacatcactatttaaaaaaccatcaaattataaaagtaaacaatagaaaagaagaaaggaacaaaggatatacaaacaatcagaaaataaatcacaaaatgacaagagtaagaggtcatttatcaataacaaccttgaatgtaagtggtttaaattcttctgttaagatctagagaacataatcctaagtcaactaacagagaaacataaaataaagcatggcatgttatcatctataagtgagaactaaacacggagtacacatggacaaaaagaagggaacaaaagacaccagggcctacttgagggtagaggctgagaggaggatgagaattgaaaaactacctattaggtaatatgcttattatctgggtgataaaacggtctgtacgccaagcccccgtgacatgccatttacctacacatgtacccctgaacctaaaataaaagttaaaaaaataataatttaatgtttttaaacaataaataaataaatacattttccaattaaaaggcatagatgagatgaatgaatttttaaaagacccaattacatgcttcctataagaaatttgtttcacttataaaggcacacataggctgaaaataaagatatgattaaaaagtgtgcaggaatatctatacttgtacaagaaaaaatagactttaagtcaaaaaataaaaagagacaaaatcattacataaagataaagggatcggttcagcaagagaataaaacaaaggtaaatatatgtgtacccaacactggaacacccagatacataaataaaatactattagagctaaaaagaaataatagaccccaatacaataatagttgaaggcctcaacagcccactttcagcattaaacagattaggctgaaaatcaccaaaacaacaacaaacacagcctgaagtacagaccaaatggacctagcagacatttgcagaacatttaatctaaaagctgcagagtacttgtcatcagcacatggaaataaactatacattaggccacaaaaaaagtctcaacacattttaaaaattctaaattatatcaagtctcttctcagcccacagtggaataaatctagaaataaataacaagaggacttcagaaactatacaagtaacctgaaatttaaacaacgtgctcctaaatgactatgagtcaatgaagaaattaagaaggaaattaaaaaatttcttgagacatgagaaccaaaaccaatgagatagaagaaaattagtgcagagagggctgtttatagcaataaacaccaacatcaaaaaagtagaaatacttcaaataaaacctaaatatgcaactcaaggaagtataaaagcaagagaaaaccaaagccaaaattagtagaaagaaaaaaataataaatatcagagaagtaaatgaaatagagactaaaaaaatacaaatgatcaacaaagcaaaaagctgacttttatgattcgataacaaaattgataaaactgctaagctagactaaccaagaaaaacaagagagggcccaaatgagtaaaatcagaaatggaaaaggagatactacagctggggaagccaagacgcaaaggatcatcagaaactattattaacaactatgtacttaaaagttggaaaacctaggggaaatagataaattcctggacgcatgaaatcttccaagactgactgaggaaaaaatagaaatcttgaacaaaccaataaggagtaacaagattgaattagtaataaaagtcttccaataaagaaaagctgagggccagatgattttactacttaattctaacaagcttataaaaaagaactatcaccaatttttctcaaatgactcaaaaagattaatgaggatgaaattctttctaattcattttatatggccatcattagcctgacaccaaaactagacagggacacaacaacaagaaaactacaggccaatatccatgatggacatagaggtagaaatattcaacaaaatactagcaaatcaaattcaacatcacatctaaaagataatgcaccaaaatcaagttagatttatcccagtgatgcaaagatgcttcaacatacacaaatcaataaatgcaaaacatcagattaactgaatcaagaaaaaaaaaagttcatgtcaggaaacacagaaaaagcattttataaaattccacatctcttcaagataaaaaaaaaacctctcaacaaattatgcatagaaggaacataactcaacatagtaaaggccacatttgacaaactcatacttaacaacatgctgaacagcagaaaaattgaatacctttcctccaataactggagcaagacaaagatgtccactttcaccaatcttattcagcatagtattagaaatcccagccagaacaatcagacaagagaaagaaatgacaggcatcctaattagaaaagagtaagtcaaactgtccctctctgaagatgatataatcttatatatggaaaaacctgaagactccaatcaaaaactcttgaaattgataaacaaattcaataaagtctagataaaaaaaacataaaaaaccagtagcatttctatataccaataacaaacaagtacatagaccattgacactataaggcaaccacacaaacatgtcaacatgtctgcataataatgagctaacaacacaatgacaggatcaaatccacacatggaaatactaacccgaagtgtaaatggactaaatgccccaatcaaaagacacagagtggcgagttgaataaagaagcaagatttaatagtatactgtttttcaagagacccatttcacatgcaatgacacccatatgctcacagtaaaggggtggagaaaaatctaccaagcaaatagaaaacagaaaaaagcaggggtttcaattctaatttcagacaaaacagactttaaatcaacaaaaattaaaaaacacacacatagctgggtgcagtggctcattcctgtaatcccagcactttgggaggccgagacaggcagatcacgaggtcaggaggtcgagaccatcctggctaacatggtgaaaccctatctctactaaaaatacaaaaaaaaaaaaattagctgggcgtggtggcgggtgcctgtagtcctggctactcaggatgctgaggcaggagaatggcatgaacctgggaggtggagcttgcagtgagctgagatagcgccactgcactccagcctgggtgacagagcgagacaaaaacaaacaaacgaacaaacagaaacaaaggaaggcattacataatggcaaagtgctcaattcaacaagaggtaactatcctaaatatatatgcaccctacataggagcactgagattaataaagtaagttcttagagacttatgaagagacatagataaccacataatagtaggagacttcaacattccatagacagtattaatattagacaaatcattgaggcagaaaactcacaaagatattcaggaacctgaactcaacttttgaccaaatggatctgtagtacatctacagaacagtacaccccaaaataacagaatatacattcttctcacctgcacatgccacgtgtgctaaaacgaaccacacaatcagacatagagcaatcctcaaaatattcaaaaaacccaaaatcatagcaaccacactcttgggaaacagcacaataaaaatcgaaatcactactaaaaaatggcacaaaactacagagttacacagaaattttaagacttgctcctgatggacttttgattaaataatgaaattacagcagaaagcaagaattgaaactattgagaacaaagatacaacataccagaatctgtgggacacagctaaagcaatgtcaagagggaagttacagcactaaacaccacatcaaaaagttagaaagttctcaaattaatgacctaacatcacaattagaggagttagagaaacaagagcaaactaacctgaaagcaagcagaagataaaaaataaccaaaatcagaactgaaggaaattgacacacaaaaaagcatacaaaaatcaatgaatccaggaactgattcaccaaaataattaataacatagatagaccactggctagactaataaagaaaaaaggagagaagatttcaataaacacaatcagaaatgacagtgtttacttagaacgcaataacccctgaacatagatgcaaaaatcctcaacaaaatatcagtaaaccaagtttagcaggacatcaaaaagctaatccaccatgacgaagtaggctttatccctggcatgtaaagttggttcaacatatactaatccataaatgtgtttcatcacataaacagaactaaaaacaaaaaccacataatcatctcaatagacatgtaaaaggctatcaataagattcatcatcttctcatgttaaaaaccctcaacagactaggcatcaaatgaatatacctcaaaataatgagagccatttatgacaaaatcaaagccaacatcagctgcatgggaagaatctggaggcattccccttgagaattggaacaagacaaggatgcccactctcaccactcctattcatcatagtactggaagtcctagccagagcaatcaggcaagtgaaagaaacaaaacacatccaaatagaaagagaggacgtcaaactatccctgcttgcagatgatatgattctatacctggaaaatatcatcatctctgcccaaaagctcactgatctgatcaacaacttcagcaatgtttcaggatatgaaatcatggtgcaaaaattagtagcattcctatacatcaataacctacaaggcaagagccaaatcaagaatccagtcccattcacagtagccacatgaagaataaaatacctagggatacagctaaccagccaggagaaagatctctacaagattaacaaaacactgctcaaagaaatcagagatggaataatcaaataaaaaaaattctgtgctcatggataggaaaaattaagatggttaaaaagaccacactgcccaaggcattttacagattgtatgctatgcctatcaatgtaccaattacattgtttacagcattagaaaaaaaaaagtttctaaaattcatttagaaccaaacgagagcctgaatagccaatgcaatcctaagcaaaaagaacaaagctggaggcatcacactacctaactttaaactatactataaggctccagtaaataaaacagcatggtattggtacaagaactgacacagagaccaatgaagcaggtcagaagataagaagataaggccacactacaaccacctgatttttttaaaatctggcactgaaaagtaatgagaaaagggctctctattcaaaaaatggtgctaacttcctagccatatatggaagactaaagctggattccctcctttcaccatacataaaaatcaactcaagatggattaaaaacatacatgcaaaacctaaaactatgaaaaccttagaagaaaacctagaatataccattttgacataatccacagcaaagacttcatgacaaagactccaaaagcagttgtaacaaaaacaaatagacaagtgggacctaagtaaactaaggagcttctgcacaggaaaaggaactatcgacagagtaaatggagaacctatagactgggagaaaatatttgtatattttgcatcagataaaggtctaatatccagaatcaacaaggaactgaaacgaaccaacaagcaacaaaacaagcaacccttccaaaatgggcaaatgacatgaacattaagtttataaaaaatgctcaatatcattaattgttagagaataaaaatttaatcatgattgagatatctcataccagtaagagtggctattattaaaaagtaaaaaaaataactgaagtttgccaggttgttgattaaagggaaagctatatgctgctggtggaaatgtaaatgagttcagccactgtgggaagcagtctggagatttcttaacttaaaataaagctaccatttgacccagcaatcccattactgggtatatatccaaaggaatataaattgttctaccataaagactatacatacatatgttcattgcagcagtattcacactagaaaatacatggaatcaacctagatgtctgttaatagaggacttgatgaagaaaatgtggtacatatacaccatggaatactaggcagctataaaaaataataaaatcatgtactttgcagcaacacaaatagcggtgaaggccatcgccctaagccaattaccacaggaacagaaaacaaaatgccatatggtcacttataaaggggaacaaaatattgagtacacatggtcacaatgaagagaacaatagacactggggcatacttgagggtagagggtgacagaagggcaagcgttgaaaaactacttatcaagtcttatgcaaattacataggtgacaaaattatctgtacaccaaacccccatgacatgcaatttacccaagtaacaaatctgcacatgtatccctttaatctaaaagctcgaaagaaaaaaacaaacaaactgcttttgtgagacatagggcaagaaaatgaaactattaaattattctatgcccagagattattgcagaagagatgggcatgtgagattacaatcagaatcagaattgattctgggggacaaaattaattcagtttttctataaatcaaacaatatcaaaagcataatgatgtaaggctagaatctgggtccatgtgttggaataacaggatattttttgagcactgaattgttctttactataaactcataaaaggctataaaaggtttatggaaatgttaccctatgatcaatatgatttaaattagatttatttataagttttcataaaattacttttaacattaacaatacaaaatgcaaaggtaaaatttggttttctattttgagaaaaattttgtgtaatattaataagagaaaataaaagatttttgtttaccctttgagtaaactgcaagggaaaaaaggaggggagagacagatttagttgatgtcatgttttcttatttctgggaaactgagtttcctgtatcaaagagtaaagctttttgctttttttgaagtctcccaattattgttttgactaaatgaatcactactttataatgacctgtgatcctattttgtgatctcaactgtcttaaaactttgatatttgacaaactttccaaaagcaaatttcaagttctaagtttggtctttttcacctcaaactaagctttttttaacttggttagtttctgaagtccaaaagagacatattaggcttatttggtatgttgaaattatacaagaacaattgtcaaatgtaagatggtgtttaactttctgtagattatatttatataaatgtgttattactatgtattctaagactgtatgagatcttgaaattctcctttgtcttaaaatgtgttgtcagtaattgttgtgattattatgttaaattgttctacgccagagaaataaccaaatttctttttcaactgtgtctttaactatgggtatcctaagacttttatcatccacaatggttgttttcttagattcttctaaaaaaataccctataatctgctatagtctagggactgcttctttgagaaagttcaggaaaagaactcttgaatgcagttttcttataatttgaaaattgtgccattgactgagaaagaaaacttccagaaatctaattaaattgggctaattgggttagcaatatttgtgaatgaataccattgaagcagagcaggagttgactacattgactgaactaatacaaagacagaaataattgttatggtattttatgttggaaacattactgattctttttgctgtttcttagggtatagagaacattttcttttgagctatgtatagcctttaacaagtaagtagagcatactcttgaaaacagaatatgagacacacctctgtgtgtgtgtgtgtgtgtgtgtgtgtgtgtgtgtgtgtgtatctgcctggtttccacttaattcagaaactctttgtgagtattcttaattcatggcaatgtgattgtttacataagttcaataagaatcagttttcttttataatgggatacagttagagtagctggttattttctcagaggtttgactaaaatggcatgttttcacatataagcagactgctttgagaatttgagattgactttatagagcccagcagagctcttgataaaaactggtcttgtgccttgtctatgaagttcctgtagttcctcttcaggatgcctggcctgtggtgatagagtgtcactttcttacaggcccaggaacctcaacttttttgaggtcctcaagaagagaagggtttacccatttcatgcaggtatctgcagtcgtaggtgaatccttggctgggcttgagaggcctttgaaggtaaagacagattccttgtgagaggttccagcaaagccaatataggagggcctatatggacaatgattcttgctaaactttgtgtgggtaatcaggccaaatatagtgggaatgagcgtattttgcagatagatttgtcttgctatgacttgcttttggtaaaagttgggaactggagagagaaatattgtatttcagaagaaaactatgatattagattagcctttgattcctggatggccacagagtcacccatgatatagagctgccaacaacacacctcctcaacatgaagcagtcagaaagatgatcagattctctatgattgaggaattaataaacagaaagaggggcactaattgtggctgaattgtcctttagaactgatttttctactttcttttgaataaacgtagaaatggactctcctagtcttaaaatttaagaaaatcccatttgtcttacctgagtttttttcctcaggaaacaaaccatcaggcctctcagacagaatcaaagaaatgaaactttctgtatcactgcatctggacaatgagatgccagatctctcacctgtcaagactacctaaccacccatatgcttactgttgactaaatcctcttccttacccctctctaattcttgttttcccacacacagtcacatttcttccctgctgtgtaaaaccctaattttactcatttggggagacagatttgagattgatcaccctcggctgcatcacctgattaaagtcttcgtctttgacaatacttatctcagtaattggttttgtgtgtgatgagcagcaggacctagacctaacccctggcatttcagtttccagaagtattaacagaagaacagaccaagctgaggaaagaatctcaaagtctgaagaccagattttgaatcaactcagtaatacaaaaagagaaaaataatgaacaaaacctccaaaaaatatgggattttttaagcaatcaaacttatgacttattggcatccctgagaaagacagtgtaagcaatgtggtaaacacatttaaggatatagcccataaaaatttccccaattttgctagagaggttgacatgaaaattcaagaaatactagaaaccccagtgagctactatataaaacaaacatctccaaggcacatagtcatcagattcaccaaagtccaactgaaaccaaaagtcataaaaggcagctagacagaagggcatgtcacaaacatgggaaccatatcaggctagtagcagacctctcagcagaagtttgacaagcccagaaaaattgggtcctactttcagtacccttaaaataatgaatcctcaacaaattacttcatatcccaccaaactaaacttaataaatgaaggagaaataaaatccttctcagacaaacaaacactgagggaatgcattacaactcgaccagccttacaagaggtccttaagggaatgttaaccgagaaaaccaaagaacaatacctactaaccacaaaaacccactttaaaatatcccacagacactgcaaagcaactacacaatgatgtccacaaaacaaccaggcaaaaacaagacaataggatcaaaaccatacatatcaataagaaccctaaacataaatgacctaaacacataacttaaaaggcatacagtggcaagctgaataacaacacaagacacaattgtctactattttcaggagaccattagacatgtacaagcacccacaggttcaaagtaaatgaatgaataaagatctattaggcaaatggcaaacaaaaaaagagtagaaggctctatttttctattagataaaacagactttcaaaaatgtaaaaggacaaataaggtcattacattgataaactcttcaattcaacacaaagactcagctaaatatatgcacatctgacactggagcacccacattcactaaacaaatccaccttgacctacaaaagaattagatggccacacaataatgtgggaaacttgagtatcccattaacagcattagacagatcattgagggagaaaactaacaaagaaactctgcacttaaactccacacttgactaactcgacctaataggcatctacagaataccccaccaaactgaatacacattcttctcatttgcaaatagatagattctacgatgcatagaatatgcatcatattcatgcatattcattcattgtatattcacagaatatacaaacatattctatgatggaccacatgctcagtaatgaagcaagtatcaataaaataaaaaaatcaaaatcataccaagcacgatcttggaccatactgtgtaaaaacagaaattgatatccagaaaatctctcaaaattacacaaaacatgaaaattaaacaacttgttcctgaataacacctgggtgaacagggacctattaaggcagattctttgaagtgaatgaaaggacacaatttaacaaaaatcattgggatgcagctaaagcagcattaagaagaatatttatagccctacacactttcatcaagaagttacatcacaaattagcagttgaacattgcacctagaggaacaaagaaaaaaggaacaaatcaacccaaacccaaggaaagaaataactaaaatttgaaaactgaatgttattgagacatgaagatccctaccaacaatgaatgaaaccaagaactgcttatttgaaagaataaacaagataaacagaacactggctagattaacaaaggaataaaaagaagatacaaagaacaacattcacaaatgacgaaaatgacattacaactaatctcacaaaaatataaaaggtcctcagagactattatgaacactatgtacacaaattagaaagtctataggaaatggataaattcctgaaaacccacaacctcccagattgaaccaggaagaaagtaaaaacctgaacagatagatgaataacaagctctgaaaacgaattagtaataaaaacctaataaccaaaaaaagccatgagcaaatcgattcacagctgaactctaccagaagtataaagaagaagtggtaccaatcttaccaaaactattgaaaaaaattgaggaagaggtgcttcttcttaactcattctgccaagccagcatcagcctgataccaaaatctggcacagacacaatgagaaaagacagcttaaggccaatatctctgacaaacatagatgcaaaaatcctcagccaaatgaatttgtcatcatatcaaaaagttaatacatcatgatcaagtaggctttattcctgtgatgcaagactggttcaatatgcacaaatcagtaagttgtgattcatcacataaacagaattaaaagcaaaaaccagatgatcatctaaatagatgaagaaaaacccttcattaaaatccatcgtcctttcaagataaaaaccctcagtagactaggcattgaaggaacatacatcaaaataataaaagccattatgataaacctacagccaatatcatactgaaagggcaaaagttcgaaccattccccttaagaactagaacaaaacaaagtttgccactctgaccagtcctattcaacatagttctggaagtcctagccagatcaatcagctaagaaaaataaataaaacaggaaaagaagaagtcaaactatctctcttcactggcaatatgattctgtacatagaaaaccccaaagactcttctaaaaggcttctagaattgacaaatgacttcagtaaagtatcaggatacaaaataaatgtacacaatccagttgcacttctatacaccaataatgttcaagctaagagtcaaatgaataacacaatctcatttttaatagccttgtgaaataaaatatctaggaatatagcaaatcatggatgtgaaaaatattgacaaaggaaactacaaagcactgcgaaaagaaatcggagatggcataaataaagtgaaaaactgtaagctcatggattgaaagaatcaatattgttgaaatggccatactgcccaaagcaatttgcatattcaacactattcctgtcaaaatacttatatcattctaaacagaattagaaaaaaaactttcctaaaattcatatggaaccaaaaaggagcccaaataaccaaagcaatcctaagcaaaaagaacaacagtggaggcatcacactacctgtctttaaagtatactacaaggctatagtaaccaaaacagcatggtactggtacaaaaacaaaaacatagaccaatagaatacattaaagaacacagaaataaagctgcacacctacagctatctgatctttgacaaagcagatgaaaataagcaatgagaaaaggactccctattcaataaacggtgctaggacaactggctagtcatgtgcagaagactgaagctcgacccctgtctttcactatatagaaatgttaactcaagatggtttaggatttaaaagtaagacatcaaactataaaaattctagaaagaaacatagcatataaccttctcaacatcagcctttgcaagaaatttttggctaagtcccaaaaagcaaatgtaacaaaaataaaaaattgacaagtgagatctcattaaactaaggagctttggcacagctaaagaaaccatcaatagggtaaacagacaacctacagaatgggagaaataatcacaaatgatgcatccaataaaggtctgataaacaatctacagggaatttaaacaaatcaataagcaaaaacaaccccattaaaaatgggcaaaggacatgaacagacacttatcaaaagaaggcatataaacagccagcaaacatgaaaaaatgttcatcatactaatcatcagggaaatgaaaatcaaaaccacaatgagatgctaatttcacaccagtcagaatggctattattaaaaagtcaaggctgcagagaaaagggaaagcttacaaaccagtggtgggaatacaaattagttcagccactgtgaaaaacagtttggagatttctaaaagaacttaataaaaaactatcatttgacccagcaatcccattactgttatatacccaaagaaaaataaatcattctgccaaaaaggcacatgcactcatatgttcacttcagcactattcacaatagtaatgacatggaatcaacctaggtgcccactgacagcagactggataaaagaaatgtggtacatacacaccacagaatactacatagacataaaaatgaatgaaatcatgtcctttgcaacaacatggatgcagcctgaggccattatcctaagtaaattcacacatgaacagaaaatcaactaccgttttaagctaaacaaagtgatattataaaaattataagaaagtgaaaatacacttacagtactgtactatatttatcaataccatatgtttacattgtctgtttcaagatgaatcatctgtctgaaatggcaggcaactacagctgcagacacatcaatctatgatacatatcaagcaattcaattttttcttgtaatgtcatgacttttctctgtttcttgggagcacttccagcatcacctagtggcatttcatataggtcccaccgtgttcggcaagctttactgtattgcaccaaacacgataaaaatacttgagaatctcaagaaatcactttttactatgatgagcaatttactggaaagatgaactgctaacagggagatacttaagagtcacatggtgttttaagcagatattcccaacaggagctcatcacaatagctacaggatgtggctacaaaatgattatagtacagtatgtactacagtaggtacattcagtcatgatttaatactgtatctttacatttgtttacatttatctcagttgtgaatgacaccatgtagggcatttgggtgcaaaagttttgataaactgtaactttttataataagatatgtaagttttatgatagtaaatgataaaatattacctacatgtattttacatatttatgacataactttttcttaattgtttcaatatgtctatgctacatggattatctgcaagattttttgagctacctcacatttccaaaacttttccaatatatttactgcaaaaatccatatttaagtgaagcacagttcaaacctgtgttgttcaaaggtcaaccgtatatctagtaaagcaattgtgactgatatcaccacctgataattttatggtagtccaccatttcctactatgatccacattttttttttgcagaagctggggagctgaactgaatagaaatgtggatagcactattatccctgaattttcaaacactttgactgagggtgttaatcccagaatttattttcacgatgtcggtatttttccttatttgctcgcttgattatataggggcagaggcacagtttaaggagcctgcacttgaatcctcttgctataatggctctattcaggtcaagaataaatgtggttttatatcaactgctaatgatatttatcctaattgtacatttggaaacagaaaaaaaaaacatagggtaaagtctccagatgcactggatgcactataaaatgaactcaaataaaaactatatttaccacctggcttctgtaaattctgaataagacagagaactacagtagcattttgtgttctggaaaatgtgtcagttctatgtaattctccttgtaagtccatatttatccatctgaaggactatgtgtctccttgggaacagtttaaaatacttactgcatatatgtgtggtgacatttcaagatctttccttaaggtgtcccagcttcctcttcaatgtactctggattagcaaactagtttagatttgcaaatttagatgaggggcaatgattctgcacaatggaagctgctatcaggccttttctcactgatgttgatattttcttattttagaaagttaagaaatatcctaggtgactggttacttgctttaccctaaaaacaccacgattagccaacaccaaaaattcctgcaaataatggaatcttgaaagccaatccagcttttctgcctattgtaataatgtccagtatgcttttgaaaataaaattctgccacatttctcctactattctgtgatcaaataatccatattattcacattgatatttggcatccatttctatggaagcatcccgtaaaatcaatccaaatctcaatgcaggatttcttattgccctaaaatagaaagtgtcctctgggctcacctctaagaaaaatagccaggtagtaaaaatccaccccagtatttccatcaacctttaaaagactatgccaaggaagttccaggatacttgcttcattatgtacatcatctctgaatctagatgtcaaggaactattgtggtattaaaaaataaacttagtcacattaacatttttaaagtttattttagcggacagtgactcatgaattaggcaataccagttcagtgctccatttgggtgaagggttcatgtgagacagaaacttttataaggtgtttgcggaacaccttataaaaagaaaatatattcaattggttacaggagaaaggccctagttaaagtagtgtttttggtttctaattggtaaaatctctaggttcatcttactctttacattttgcttcagtttgcttatgtagaaatgtaacacccaggagccatctcaccttaacggccttccaataaattttttttctaacactgaaagattattaaggccaactttaatagtacttgccaaaacattgaatcttgtcataaagaacataacttcatgtctatcaactttcctcttccagccttacatcactttagcctaattcattgaaatatataaatctgcgtatttccaaattttaccagtatatattagccaagtcttacagtttctctgacatgtagactattgttttccagatcagcacttgtacttccacattgtacttgcctattctgttatcaagctggtgttatgtgggtgatttttgaggaaaacaagcatcactttgtgaggtacttccccatatgaggatattacatggtatccacagattgggaggggggttcttttagcaaataagaggttacttgctttaccctaaaaacaccatgattggccaacaccacagattgaatcctcttactataatgtttctaccagatagtaggatgcaggcgaattagagtgttcgagactttcaggctctagccaatgctcctctcctgtgggtccaaggtccacttatccctaacttttatataggcgacacggtccttgacttttacttgagagagttgacaaagttggtaagttagtgtcctttatatctctgccaccttgaaattagatcataggcacagcttcatagcgaggaaaataaagttcttccctaaatgtacaataaaggtattctggttttgagagtcagccaaaagctctgagtctattcttttcttttacagcttccttaaagttatactgctttcataacacttcattgctgaagttatttaatctcctaataccctttcttccatatatacctcatcaaaattagccacaagggaaagcttaatttgtaatgctatagcatactaatgatggggcatctattatattcagacagctggaaagtaaaagtaaaaaattatatcctgaatgttttcttttgaggaccacctgtactacaaatgttcatagcctgagttaccaaaaataaaaagcctgagatgagaattaattgttgattctcattataagaagtacaacctgagagcagtgagagtgagtgaataagcacgtaagacaggaaatgatacctcacaaaatacctgggatagattactgtgtttcacaatgagccacaagaaaacacaggaagttgcttgactggtttaactactcagccataaaggaaattttggaatagactgcatggagaatctattctagggtccatgatttctccatctaaatcctatgtacgcagacttttttttttttttttttttttttttttttttgagatggagtctcactctgtcgcccaggctggagtacagtgtcgcgatctcggctcactgcaagctccgcctcctgggttcatgccattctcctgcctcagcctcccaagtagctgggactacaggcacccgccaccatgactggctaatttttttttttgttatttttagtagagacggggtttcaccatgctagtcaggatggtctcgatctcctgacctggtgatccgcccaccctggactcccaaaatgctgggattacaggcatgagccaccgcgcccggcccatagacatattttattttcctcaaatatattactacatattaaagtatactcataagataaatctcttatctttttgcctgcatattcccatccatctttcactcatttatttattcaacatttgtttattaaacaatatttgaagttctggatatacaataatgggtgacaaatgcaaccgtaagccagtctggtcagattgagataaaagagaaggataaatagggaagaagaaggaataagcacagaggaaggagaaaaaattaatcttcctagtttcctcctggcttctatttcccactggtcaaagttcatgccaaaagaaattacatcttacacatttctctattgtgtcatctgtcccatttggtggctgcttagggatcctggtgtcataatctgtgtgctgagggaatacatcctctagggttatttaggagtgtcaaataattgttttggtatcatgtgaatatgagatgtgcagagaaaaaatcccttcataaaagtgtccggccatatgacatatagagcagtagaacatttcttgctaatgtccttaaagactgactttcagtaaggatagcaaacctgatcaaagcctgcctctaagacataaatcagttttatattcagggaaaaggctgcaacctgaaattatatacacatctcccgtatcaaaactcggcagacagcagcttacgtatctaagcatttatgaccagacagtaagttcatcaaagtaccatgaaataaacctgacattaagtatcaaggtgacagaatctctgaagaaaagaacttcatactgtaaaaaggatagtaggaacaaatgatttccaaatatttatttatgaaagcattgtagattgcatcattaagtaaaaacgtgcctgaaaatgacctctgtgctcaagtagaaataattttttcagttcaataggagcttgatttcataaatggggttcctttttactaactttgaccctttctacagcccttctttcagtcaagtcaccagcagaacacccattgtttctttgagtctcaactgaatttgctctttcgattcatgaaatattcttccaattccttcatatatatatatataacttcccttgaattctttaattcctctatcaaaacacttatgttttctataattatgagtttccatgtcataattttacacctaatgagaacacaaatgttttcaaagcccctaattcaacgtctaacaaatacagcattatgtaccaagtaagaatttgttgagtaaatgattatgggccttagatgacacagccccaaatacctgctttcctattagacactctttccactcattcactctagctatgctagcactcttggcatctccaattgattttactgcctcaaatccttggcatttgtttactgccttccttctctcccccagctatccccttcacagctgggttgttttgtccttattttttaatcacaagctgacctgccaaaggcttacatttgtatttatcattcgttattctatgcccagagcttcatatagtgttaaaaaattgtggaataaataaatgaaggagtgaaaggtaaatgggaatatgaaggcaaaaatagacaatgtctcttaggattatagtttaatattcaataataaatttgaaggaaagaaaataaaattttttgtgcctatgtaccaaactcttttttttggtgcttaaaatacattatttaagttaatcttctgaagtcattttgagatagatattacttaaattttaaatagaaaactacatccgaggaacccaggtgaatatgtgaaaagtacacgtaattatgtggaagagccaaggttcattctaatgctcaacttcattattgactgttttctttacaacatttatcatagtatttacagactacaaagtaacataatggaaaatattgaggaagaaatttagatgtagcttaattatttgtgaatgcatataactcaattgtggaatagtattaaaaaatcaaactactgaacttaaataccaattaatatgtttgtcaaaattatttatccaaaatataaccagttaacgttgaatatcagtgaagcatatattagctttaatagatttttaaaaagtataatatctgactttctgaatataagctctacattggtaaaattattttcaaatttggtgtatagtaattgctcaggtataaaaaggcagatatttcaggcagaatattcttgcccctttcttgttagcattttgtatgttaaaacagtaaaaattattagatgctgttctctaagtatctatcaacagtgaatctacaaagttatttgagtttgatgtaccaatattgtagcatatacttggaaaagcgaagataacaatttattgtaatattaaattatgatataactttgatattataaatttccaaggaaaaatacatcaaattgctagagtttttttcagcaatgctaagtaaagcaatgaggtcctcaagaaaggaagatactaacattgaatttaactcatttaataatttgctgaggaatgcaacaacaggtatattttgatttctcattaaaatcctgtctgttgaattttcaacttccactcagaaaacatttcttaaaacacaagagaaaagaatcaaatagataaaagttcaaacaggtattacgtacaattaaaatttccaaatgttttctatgtttttctcattaagttttcatgttttatcaaagttgctttattacattatgaatattttccttgcccagtgccacccatactccacttttgtcgaagagtatccctttcaccccatttgatattctctacttaaaccattacgggggacagataccaaagatgaccacctctcagtaatgacactagacccctctccatctctgagataatttttgtcagggcacatgactcttattataccagccgcaatcactccaacactgtgagaactatcctgagatgcttcaaattgtgtcctttgctttccagaatcacagcccacaatctatgctggactactcgtaactacaaacagagagggagcaaaagatcatcccttataaaaattttatcttctagaaatgggtagtaacaaatgatcgggtatttttttttaacactaatacagtttgacatctaatgcaaaaaatcaattttctccagatttaaataagaagatcttctccagataataaaatcctcaattattctggagtatgaagcagaaaaatcccataattttcaatagccaatatctcaaaatatactatcagtatgttgtacagaattaaatccacatcttttttttttctctatatttatgcagaacacattaccttaggtcattattagtataaggaaggaaatgagaaacaaggtattttacgggtgcattaaagcgttgatttctatatctgtaaacgacctttaaatagccaaaggtagttaagagaaaaacatattttgctcatgaaagatatagctttttattttatttattttttttttttttgagatggagtctcgctgcgacacccaggctggagtgcaatgactcaatcttggctcactgcaacctttgcttcctgggttcaagcgattctcctgcctcagcctcccgagtagctgggactacaggtctgtgccaccacacccagctaatttttgtatttttagtagagacggggtttcaccatgttggccaggctggtcttgaacccctgacctcaagtgatccacccaccttagcctcccaaagttctgggattacaggtgtgaaccacaacgcctggccgaaacatatagcttcttatatttaatgtttaatatttcttacatttaaccttgactacgaccatccatattttaaaagccctgataatccccaaagaaaaaacacttcttaagtatgattatagagttgctggaaattatctgaacataaacctctccccactcccttatttttcccaagcaatgttatctgaaactgatgaaactttttatttgaaatcttgttctttccagaactattgatctactatatggataccccagatgtatcacaaaggcagagaagaaagtaaagctcctctgcagatttaatgcataggttggggttttagttttaatttagtaacaacagcaggattagtctacttaaacactgaaactacagactgggggcagtagctcacccctgtaatcccagagctttggaaggctgaggcaggaggattacttggggccagaagtttgagactagtcttggcaacgtagtgagacactgttgctacgattttttttttaattagccaggcatggtgacacacctgtagtgctagctaccaaggaggctgaggccagaggattgcttgagcccaggaggacaaggctgcagtcaggtatggcagtacaactttgctccagcctgggtaacacagtgagtgagatgatctcaaaaagcaaaaagcaaaaaaaaaaacaaaaaaacaaaaaactagaatttacttataaccatctaatgcactcctttccttcccacacaagatttcaagtcattatggttttattcttaatttcttaattcctatctttgcagctaatcaatacttcctaaaatggacatgtgtccagcagaatagttaggattcttcagtaggtcaaagactagtccaagaagtattctggccaagacatgatggaactgatggaaatgttattttttccccttctttttactctaaggaaacacgactgaaagtagaaatacttctacctaaaaatgtttaaggtaaccaaggttattaatccaatgtcattcaatgccacaatagcctggttggcacataaaaaccttgcagtgccatatttaatcacattagcaagtccaataagaagtatcataaggagaaatacatagtaatactatatcataccaactacaaccaaaatattcctgatcagatgaaagctttctctaaataaaaaatcaattttgtgaaatggtaaggagagagaagtgtataaaatctgtatgaaatctctcaccttttcttcagggttctctgctagatggataggcttctcgaaccctttcaaactgtcaaactgtcctctacaaagcatcttgttattgttctttcttcctaccttgaccctaatgactacattcttcacactttgccattgtttcccaagcttacacttcaaaaaggatactgtcctcttctcttctattactgaacatacacctgacaaactgcagtgacaatattcaattcacagaaccgcaggtttgacaagctccaatcacagcacatacacgtgaatttagaggaccttatcttagattacattatactatgcttttgtttgtatttttattttccaatgaatgttagcatttttattgttgattgatctctgcacttattaaagtatttatctttgaactacttatttcagcttagaaacgcagatatctggctaacattatctcccagccagcaaaaaaattggtgagtatattccaaggtaacacattttcttgactccataaaagaattgaggtcataaggcaagcaaccaacctgaaaacgtgaaacagagagtcccatacctgcagattaaaccagattccaagcatttattttcctggggaagatgccaccagaacttatagaagccaacagataaatgaaactggaaattttaatgcattgttggaggatgaatgtagactaccatgaaagtaggatgtctacagaggaacattgatatttggattcctactcattttcaggcttttcctctgggaaatccatcaggttttcctggagaggatcagagacattgtgctggcttcaggaaaacatcaaccactactgaaatctgcttacatcctctatctcccttgtagaataaagagtgtaatctctagggagaagaacactgaggcctacatggtacaggcaagtccaagaatctcagagaatatcaaacaagaaaaataacaaatcccagtctctaaaaacagcatgtgcaaaatcaaaaacgaagaaaaaatcttgaaggcagctcggggatcgtggtggtagtgtgcagacagaggcaaaataataagaattacagcagacttttcatcagaaacaacataagccataaaataatgaagataatgaaaaaaaagttggaatgttagacacagcaaaaaaatccttcaaaagaggaaaaaagccaggtgcgatggctcacgcctgtaatcccagaactttgggaggctgaggtgggtggatcacccaaggtcaggagttggagaccagcctggccaacatggcaaaacgccatctctactaaaaataaaaaaaaaattaaaaaaattagccaggcgtggtggcaggtgcctgtagtcccagctactgggaggctgaggctggagaattgcttgaaccgaggagggggaggtttcagtgagccgagaccatgcctttgcattccagcaggtgaaactccgtctcaaaacaacaacaacaaaaatatagagtttctcaggcaaacaataactgagaaggaatttattgccaaacccagttaccctataagaaatgttaaaggaagctctttggtcagtacaaagatagcataggtcagagcctcggacctgcacaaagcaataatgagtcagaaatgtaataaatgaaagcaaagccttctatttcctactgaataaatgtggctatacaaattactaaataaaaatgtttccctttctggaacatatttagaaaactctaccttctacaatattggctccataagataaaatttttaggattcaaaacctgaagtctatttatactaataaaaaatatttgacaaagcctgagattcttggtgaatagatgtccagtggttagaaaaaacagccaatcatatatggggattatacaattccaaaatactattaaagctattccttaagtcattgattaagactgacatttttttttctgaaaattacaggataaacttcactaaaattatgaaatttacaatcttttatgaaaagtacaaaaagggaaaggttgagaaccacaactagactttagaacctcaagtatgtcattcagaactaaatatggattcggatttatgctgtttttcaccatagaggggaaaaggcacatttttttttctttttcagagaaaatctgaaagtcaaaacaatttcagaaggaaaatgacttgtcactgtaatctttttgatactatagggctatatttttggtaagtacaatgtgcatatgcaaataaagtggtcatggtatttcagtccatttgaatgaaactaaacacatgccaaaatactaaatttcatattttttaacatattgtgaattattacactaggatttttaaaagctcaaagtcttaattttagctttttcctcctatttgtacatctaatggaatctattttatataatgtagcttctttcctgagcagacttttgtagaagatgcaataattttatggcttgattagtacaaaaagatttcgaaagctgcataacaaactataattatctcattttcctctattgtttgcaactactgtacgtatactcattgctctcttccatatgtataattaacaaatatagccaaaattttccaagtcacagaactataaattagtaggaagattcaagtgtgtgaatttcttaaaaagaaaatgttttctatcagtaaaagacctcatctcttcttagggcatccaactttgcattaaaaattgttgctaaaataaacagctgaagatcacatttaaatccacaaggttttcgctgttagattagcaattccaaataaaaagttgtaagaaattaagatggctcataaatttatttaaaatatacttgactactagatgctacaaatcacataatatacaaatctgaagccagtatgaactctgctttaaagtactgaaagtaagatagaaataatgctctaccaaataggtatattatgagaatttaaagaagttttagagctctaattttgttatcacaaataaagctttcttgcctggcagctttgagttaaatctttaatgaatttgatttggctagacttcgaattttatcattaaatctaatggcaggctgggttatgacctccggtttgtaatttccactttttgcttggatgcctgaagcactccatgatattggaattcagtaatataaccaagttaaataagtcattcaatataaagttttccccagtacagaatgtcaggctaatctgcatcttaaagttttccttaattcagagaaatatttttctgttaaatatttcaaaatattttttcagttctattaattggatattcaatttcattaaaataatttgaaacaccttccaaaactagtaataaggtaggaaaaaacctcacttgaaaaagaaaaatatatccccaaagtaacaaaaagattacagtgacaagccattttccttctgaaactgttttgaccgtcagattttctccgaaaaagaaaaaaaaatgacagcaagttctttggtatatttccaaatattttctatttttgtacttatgaaacaacaacagacacatatacatacctatttttacatatatggcaatatatgttttcacttaatatttatctgattattccatgtcagtaagtaaaagtatgcctacatacctttttaaaattactatgtagtattttatagtactgtatagggattctacgttttgtttaaccagttctttatgtcacaataaatatatttgtataaatatatttttgcataggttggctaaagtcttagtagtgtaaatgtctttatcaaagaatataataattcttatctgataagtattaccaaattaccctccaaagaaagtgtaccaaaatatggtccaccaataatatatgagaatatgagggtgccaattttctcataagtcattatatattgacttctgaaatctgtaattatcttttatcttatgtctatttttctctgaatggattgcaattcacctcaacatctattttaatgtcaataattcaatttttaactgtttataattaattctgtaacttacattatttactagttccaatattggttccttaacataacaacattgcaatattacaatgcacatcaatttttattgaattcctcagttataacctatttaaaccattattttattgaacttttgttttttattaccttttctatattgtgaggcaatgaatttatcctccatagattttatttccaggctgttattttgcagcttatatgcttcgtttcatttttctcttattatgctagactatgtgtgattcattgtcgtttgtggttttgctaattcttaatatgaataatttggcatatgtcttctatttggtttaatagcgtagatcagtggttcccaaacttattggcatcagggaccattttcgtggaagacaatttttccacagactggggtgggaaggggaatggtctacacttaatgtgcacgttatttctgttattattacattgtaatatataatgaaataattttacaactcaccataacgtagaatcagtgggatccctgagcttattttccctcaactagatggtcctatctgggggtgatggaagacggtaacagatcatcaggcattaaattctcatacggagctcaatctagatccttgcatgtgcggtttgtgcccttatgagaatctgatctcacaagaggcggcaatgcaagtgatgggagtggctgtaaaggcagacgaagctttgctcgcttgcccaccacgggtcctgctgtgcggcctgtttcctaaagggtcagagaccagtacggtctgtggccccggggctggggacccctaacgtagaggacttctctttgttaccattcacaagcattatttggtacttgttttcctctcttagttacatcttgaaaacctacctataggagaggatacttttgtcattagctagtaattcattctctctcctcccctcggaaagaattggccatttggtgtttattatctcagaagagagatacgaatttgaaaatcagaggtaaaaaaaaattaccagttttgatttgtgcatattctctgtcaaagttaacaatacattacagtaaggaatcacagctagaattcaattagatcacaaataagatttacatagcctactaatgttggaaatagtttggctatctggattgcagatattcacaaacgatatatacttatcccaatacctctgtgaaatggggcctttttctgctgatccagtgatagtagaaacagcaagtggtgttcctaaataatgattatatgacaaccattgtgatgccattatttatttccatgttttatttatttcagtaatggtgttaatttttgtttgaggttgtgatcaatttctttattacaaattcttcagatttttttatttatttttaaatcaagtttgataagtttatttttcaggaaatttaaaattaattcaaaatatcaaaattcaaatgacaatgttattcaaattaccatgttatgacaaatacacatataaatacaaaattatcaattttggatttttaggtttatttgtcacaacatggttcataatagcctttcacaaatttttttatttctgtgggtctccactatgatgtcctctttttcagtcttggtattgactgtaggtatggacacctgcattctctctgtctctcattttgcaatttttcaattttatcagacttttgattcttttgaatcaactcataactttgctgatcttgtttcttgtatttttgtcctctacattaattccttattttcttaattctttcctatattttcattgagtttaatctgaagttttttttgtttggttggtttttgttgttttgagacagtctccctctgtagcccaggctggaatgcactggcattaagaaggattgcccaggaagcaaaaggaagctacctcaaccctgtccagcctgtgttggagacaactgggatgtggactgtccctggaggcataggtcaccagggccacagccagcctcacaaatggtccagcaggactgatgtgtcacggggctcctcttcctgattccaacagctcagactgtcattacaatctaggagctttgggtgattctggaggttgaagggaggaaggtgggaaagtttgaagtgaaaaatcaattttgtttggcaaatatgtcatttgacttccaaattattgcattttagataagtatttcttaaaaagttacaggtggactctggaaaatatttactggataaagttattttaactaattttgtttatatctttagagattatagagacagtagtttataataaattgtaaactaagaaattaatacaattaaaattaacaacacttttttaatgttaccattgatgtttctttcctaatgagcacattaaatatgaatttgatatgaatgaatgtggtaccaatagttttgaatttaaaatatgtaacttatgagatccttatggtagctaaatactttacatcatttttctctactacaattaatgtgaaaattccttttgcagtataagcacttttacctttagttttcactttgaacaaatgttgaatttatataatttaattctgctctgcccttttcttcctaggcttacacaataaacatgatacaatctgtaattattaatagaggtaataatacactcattgaaattatggagtcataatcaattttaagtaagtcatacaatcataatacactatatattttgattaattagaaaaacagaatttgaaaaatatataattgggtgaacacatatcaagtatttggtgacttgtgaacccatggtttttgtaatattgtctggaatcattgagcagctcttacatgtttaatctttcaaagaccaagttattcaatattcatctaaattcaagtatttggcacagtgttttcggtactgggattatatttgtgaacaagaaacaaatgtgctcttctctcataatgctggtaatacagtacagtacagatattagatgattaaacaactacatacttttactgttaaatagttgaaaatggaaaaacataaaataacactaagtgtgtgggttttagagacaacagcattgattcaaggcccctcttaacaacttttaataacaatagaatttgctatctttaaaaacttaatttcatatttccaaatgtacaaaagttcctacttactgcaactattttgaagattgattaagctaatttatattaactccttagcatataataaatgttaaaagtactagctcattttgagggggacaaaattcttattttaaagagagaaaatcctgcaaacaatttcttgaattttttcctgaaaatttactttaaaaaataaattttattgtatagattcgaagtttaccacatgatgctatgggatacatatagatattaaaatggttactatactgaagcagatcatctcactcacatagttcctttttgtaacaagagcaaatccctaatacagaccaatgttattaactatagtcctcatgttgtacattagatatacagacttgttcatcctacgtttgccacttttattctttgtcttacatcttcccattttcttctccacctctagcccatagtaagcatggttttattttccatctttgtttaattgactttgttttggattccacaaatatgtgagaaaatgcaatgtttttctttctgtggtttatttcgcttagtgtaatgtcctacaggttcatccatgttgtggcaaatggcaggattttattctttttaatgactgaataatattccactatatatatctatatctcacactttattcatttgtctgtgtagacatttaggttgttttccatgtttggctaccatgaataatgctgcaatgaacatatttttaggaggtggtgattacacctcctttgggtatatacccagaagaggaattgctgagctgtgtggtaattctatttttaatttgttaaggaactgccatactgttttacattatggatgtacctatctgcattcccaccaacagtgtgctaaggttctcttttatccataacctcaccaatatttatctcttgtctattagataaaagtcatcataataagcgtgaaataatgtctcataatagttttaattttcattttcctgctgattagtgatgttgagcaccttttcatacatttgctggccattgttgtatttttcattgaagaaatgtctatccagggcctttgctcttttttaaaccaggttctttttctgctattaagtggtatgagttctttataagttttagatattaaccctatatcagatatgtagtttacaattttttccagtccatagtttacccttttatttgctgatcatttcctttgctgtccagaattttttcagtctcatgtggaatcatttatttaattttgcttttgtagcctaggcttttgctgtgaaattaaaaaaaaaatcattgccaaggccaatgtgagggagctttcccctgtgttctcccccaggagttttatggttacacatcttaaatcttttatctatattgagttttttttttgtattgtataacataagggtccagtttaattcttttgcatgtggaaatccagttttcctggcaccatttattgaagagacattcttttcttcatgtgtcttcttgatgaccttgtggaagattagctgatgatatactcttggatttatttctgggctattttgtttcattggtttgtgtttttgtttttaggccagtatgatagtattttgattaatgaaatatagcatataattttaaatcaggaattgtgatgcctccaacttttctttctcagtattgctattgttattcagggtttttagtggttccatataaatctctgcattgtttttcctgcttctgtgaggaataccattggaagtttggtaggaactgcattaaaactgcatattcctttccttagtatggacattttaacaatatgtatcctactggtctatgaacaaggaatttcatttcatttttgtgtcttcttcaattcctttcatcactgccttatagttttcagtgtacaaatatctcacctctttggttaaatttattcctacattactttttgatactatcacaaatgggaccactcccttaactgctttttcagatccattgttatttttgtataaaaatgctacagatttgtgtatgttgattttgtattctgcaactttactggtcatttgttctaaaaaatttttaatagaatctttgaggttttctacatataggatcgtgctatctgtaatagagataattttacttcttcctttccaatttggatgcttattttatttatttgttttatgattgctcttgctagcactttcagtactatgttgaatataagtagtgagagtgggcatccttgccttgtaccagaccttagtagaaaagtttttagttgtttcccatcgatcataatgttagttgtgtcatttttgtaaatggctcttattatgctgggaaactttccctctacagttaaaccattaaaagcattttttatcaagaaggtatgctgaaccttgtcaaatgtttcttctgcatcaactgagataatcatatggttttcatctttcattctgttaatgttatatatcactttaattgatttgcatatatgaaagcagacttgtatgtcagggatcaatcccacttggtcatgatgtgtaattttcttcatatgttgttgaattcggtttgcaaatattttattgaagatttttgcattaatgtttatcagagatattgacccatagttttctttccttgtgttttattaaaatacttttttttttttttgatacggagtctcgctctgtcgcccaggctggaatgcagtggcacaatcttggctcactgcaacctccacctcccaggttcaacctgcttcagcctctcgagtaactgggactacaggtgcccagcaccatgccaggctaattttttgtatttttagtagagatggggtttcatcgcattagccaagatagtcttgatctcctgacctcgtgatccacctgactcggcctcccaaagtgctgggattacgggcgtgagccaccacacccggccctaatttgaatattaaaaaaatctgttgatatgtttccttgttttcaaatacatgcatttaagggtacacattaccattgaagcatggctctagttgccttctatattttattgcatattcacattgataaaatattttctaacatccattgtgatcttgcttttatccaatggattattttaaatagttttcataatttccaaatattacattttctagatttatttttgtaactgatctcttaacttaggaatcatagtcagagaatatattcaatccggttttaatcccttgaaattttatgggatcagtttggggtaaaaaaatagggtcatttcaaagaatttcactagcaccttaaaagaccatgtattctgtagttattggatgctttactctatatacttcaaataggttaattttgcaaatcttattattcaattttacatatctctactatatttttgtttgttttctaagttaaaaagaaaaattcgtgcttttaaaaaatttcccatcaggactatggattatgtttctttttaattctcgcagtgtttgcttcatgtatcttgagtctacgcttttccatgcatacttacaatggtcatatcttcctgttcttttttaactttttattattgcgtctttacttccagtaatgctttttacttcatagcatacttgtctgatattaataaaaacaacagctttaagatatgcattgtagagccatcttcaaattttacttgcttttttttgtattaccagatttcgaatgactattgtaagtagcacaaatttgggtttacttatagtaaatctgatatgttcacgtttcattgaaccctatagatccttttcacttgttcaccattgtatatgtgattaaatctaacaaattaatagttagttttctacttatttcaacccctactcctcactaatcttttcccttatcctgttttgaagttaggaattttaagtattgaatatttccttctgttggatgttacagaccttttacagcttcttccaaatgtgactatcctagagatgacaacatgaatctttacattatcaagtctaatatgttatctatgaagaaaatgatttccacttgaacccttaatgtctcaacacacaattactttcctttctcacagaaaacgcaatggccttcaaacactacctccatttttgcttattatgattaactcgttactttggttatctacttatattcaacatattttattaatgtttcatgcaacgcactacctctcattttttaatagaataatatttagattttgcccatttatgtattcttattattgttcatcctttctgcatctcgatgcttccatgtaagattattttcatgatctgaagaacaaacacccttctaattacctttatagaattttcgtagtttccaacttttttactctttgaaaaaaaagaaaactgtctttgttttaccactattcttgacctcattcacatatttagaactttgtgttggctgtcacctgggcctcactttccacttggtctgtcatcattcaatattcttcctgcactcttggtggaagactattgcaaggtggcatgactattgcaagaacatgagaatggaagctaaaattcgtcttgaggtttagaccctagaatataaccaagaccatttctgtcaggctcatttcaggttcagatggggaggaattcaatctcttgactgaaggattaaaaaaagaatactattgcatttcttcagtctatcataggtggtgaagtccaaagatcacccaaatttgtttaaatataagctggcgatgcagtataactttttgttactcattatgatcttcagtattatgcaccctattactggattacttttgtgatggctgctatacaacatcaaattgatttttcctgttcagtcaattttttaacttcttggagaccaatacagagttccccaaaatacttacatacacagggaggctccaggtccccccactgtaccctgggtcccttctcgtcctgcagtgagcctcctgaaatattccaagtcccgcctgcctcctccagtgacaggaaaggctagccggggacaacgccattggctgcctgagccttgagaaagatgcacaagttccctcggaggcccagcaaactcatgctggcccgtaaggctcacgagagcgtcctcggccctccatcggtacctaaaattactctaagtccactcagcgaaccagagtcctggaaccgctcttgccgtcctggaaagattggagaaagcattaccgcctgtccaagtgtcttcacaattttctacctcagctcaaagcctagaactattactgtgaaaactgaagcgcaggtcagcctgactgacccttcggaaggcgtgaacaagttcccttgaggacccagaagcttagggggcttgcctgaagacccacgaagggagtccttggcacaccagggccaccacaacattatctaagcctactgggggcccaggaacaactcttgccattcgagaaaggctggaggaagcattaacacaaacttaagagtcctcagaattttctacctcagctcagagccggaaccgccattactgaaaacaggcgcaccacggacaccctaggccctgcacagagagggcgaccggaacataacttttgaggaggataagatttgcattatagagtgggattcatatcccagctgagaccttcgtagctgtatgatattggcaactttactttgcgtctttattttaaaatgcaaagaagataatattagtgactacctcaaagtttgccccaaggatcaaatgtaatgttgatccgaggcagagtggtgtctgatattaaagacttcattaaaaataggtttattatgtgtttcatgtgaagtaaaggactcatttccaatacaaatacaaataaactagtcctttatttcacattaattttccttgttatactttgactaaactttggaatgctttttctcctttctctcatgtgcacagtatttttgcgtactaattgccattccaaccattaaaatgagattattcacggccatcattattattgctgtgttttttccacacaatgtgtatgtgtcaatgatttcctcaaaattatctttccctattcacattaataagcagtaacacattaaataagcagtaactcacgtttttctagttattcataattgatcagataaaacatttttatttattttaatttcaaaatctccatttcacaaaaagcaacagatgtacgaatagttaggaaatgtcttaaacataaggataattttcactgacattcataaaaattcaattttaccaatagtaactgcatatataatgactggtagaacatttaattttttcactattcataactgaataggtaaagttcaatacttttccacctaaccccacaaaatattcatgactaaagagaagaggcttaatactgttccagatgctttcaaggagtttatttctgttttaaatattaggcttccatgtgtattttacattaaataaagtgtttgataactaaagaaataaaaagttagtttagaacatcccagtctcatcagaaagaatggttacaatataattttatatcagatgaaagattaatcatgttaaaacagcccagaggcaattatttgtattctctgtgcagccagttgaactctttctctagctaacattactgctaatataattttcaaaatggctgtctcttgtgatgcctaaactttttacttagctgagttctatgctgcctgtaatatggatatacactcaaacaaatgaaagatttgaaaaataactttattaagacataatttatacatcatataattcacctatttagtacaattcaaggatgttttaaaataaactttactaattgtgaagctactgtaaatcagttttagaatatttgcattacccattatgtccttcatgtccatttgctgtgaatcctggttctacctctgcccctcacctcaggtaatcactaattcattttctgtctttatagctttgccttttctggatatttcaaatacataaaatcatataacagtactctcatgtctggcttctttcatgtagcacgtttttgagtttcattcttgttctagcatgtgtcagtagtccattcctttttcttgctggataatattctattgtatggatatatcatattttgtctactattaactagttatgcacatctggattgtttctaatttttggctattatgaatactgctcataagaatattcatatataagtctgtatggatataggttttcatttatcttatgtagacacataagagtgggattgctgggagttatggtatggctctgtgtccccacccaaatctcatcttgtagctcccataattcccatgtgttgtgggagagaccctgtgggagatgattgaatcctgggggcggttctttcccgtgcttagcccgtgctgttctcctgatagtgaacgagtctcacaagatctgatggttttaaaaatggaagtttctcttcacaagctctctctttgcctgctgccctccacgtaagatgtgacttgatctttttcccatccgccatgtttgtgaggcctccctaatcatgtggaactataagtccaataaacctctttcttttatgaattgcccagttttgggtatgtctttattaacagcgtgaaaaacggtctaataccactgggtcatattgtgaatttatgtttaactattgaagaaactgccaaactattttccgaagaggctgtaccattttacatctccaatagcaatgtataaggattcccatttcttcacttcctcactgaccttagttattgagttccttttattgttattgatattctagtatgtgtaaaaaaagtatctaattattttgatttgtatttccttaatgattagtaatgttggacattgttcatattcttactagccgtttaaatatcttccttggtgaaatgttgcaataaagagtgtaaaccagaaataaaattctaagcaacccaccccctctccatccccagccatctgaatgggcttcctccttatccagggcactcctaaaatttaacatgaaagactgattcaggccgtgacggaaagtcggggttggacatgccccattatacattttgggcattaacatcaacacaaactttaagtctgataaataacattttacaacctattctctctaaagcctactacctgaaggcttactctgcaaataagaactttggtcttcacagtcctttatcataacccagacattcctttctattgatcctagacttcagataaattcaaccaattgtcaaccagaacatttaaaaatctatctgtaagctggaagcccctgctttgagttgtcccacctttctggaccaaaccaatgtatttccttaacgtatttgattaaagtctcatgcctgcctaaaatgtataaaaccaagctgcaccctgaccaccttgggcacatgttgtcagtatctcctgagggctgccttatgggccatggtcactcatatttggttcagaataaatcttttcaaatattttacagaatttaatccttttcatctactagagtctggatccttgtgtgatgtttgcctgctaacagctttcaagtcctagcactaccccttccctttctgtctcacatctgagaaagctgataagaaagcccttctttggtaccaatgggaagttcaaaccatacaattctttgcctgtgtatgggaatccttgccatgctcgccacctcaaccactataaaaaccaagccattctcctttcctgttatctcaagccactttcagatcagcttgggaggtcacattgttctccctaagaaagtctcattatgtgagtaacatatttttgatagccttttgatgcatgtgccgtttatcagtctcaacacccaaacaatatctggggtttatccactctagagtaactccaacaatggcacagccagcaggatgacgaacactaccaccatcagggatttgtttcttactttagttaaaaccttacttgagattgggtccttaagccccatgaaacacgactgtcatttagaaaggccctgatgatactgattttagaatttctggaggaagaaatttatgagccagagaagaacacctctctgaagtatagcaagtaactactaaaagttaaaaataaaaacaaaacaaaacctacatataaggagggaaacaaacaaaaacaaaaaacaaaagcagaggtccacaattagaaaaaaaaatttcaaaatttactttaaaatctatacaacaaaagtaaattgattggatttgtgcctctgtggcacaggttctgaattaactttaacacattttgaaatacactaactggcaaattttcattaccttaatcgaagggatccaattatattttacagggggttgcaaataaacttaaacaaggtgtcctatatatataacttatactgggtataaaatagaaaacaaacaactaagcttcaagttaaccgtcagatccatcacctaaattctccatagtcatatcacccattgtcctaaaatatcttatagtgaacatggacattcttaattagtaataaattaaatctttggcacatataattggcttgcagaatgggaccccatggcatacttgtttggctaaaatagttcttcacaatgtgaattaaaacagtgccttaaaggactgaaacctattataaaagatctaaatcaccagagaacaataaatcacctataactcactagagaactggtaattatcccatactgctcaatttaacatactaatttggcctgtttttgttgtttttatttgtttgttttagagatgaagtcttgctatgttgcccaggctggactcaaactcctggactcaagggattcccatgtgtccgcctcctgagtagctgagacttctggctaacctgttcctaatttggaaagaatgagtggtgtcttgtggtcgattttaccatgttgatgctgtggtctcatttgttaaggcccccatgtacaatataactaaaattactaattccatcaaatcaacaactggtaaattatttgcagtcatagattggttaatatgttctgttcagtgcctatttcaacagccctttatctgtttatccactgggtacctcaacagccttactttgctaatgattttggcagactagatcttaaccacatccaaatttctccagtaatacaagtataacattacattgttcatattctcctctgagaagattcactggactcactcattcaagacatataaacattcaaaaaagaactcatgaaaaggaaatgggccatttccccacatgtagtcatagaccctgccacctcatttaaatagatgaaagttatttgataagcggagagtcatttcatctctggcaatgtccagaaacttctattggccttctcattacctgtaagttaaaataagttcaataattttaggtctttttgaattctgcaggcaacatattctgcatttatttaagttcagttatactgttactcacaaataggcccatcttgaatggttccccctgcaagaaaaggctctgaaatctgtccaaattgcaacagaacaggcactctcattagcggcctgcagagaatccattactgctgaggcttcctagagtctctggaccactcatgaggactataagttgtccaatctcataagcttaagacaaatggtactctcaggatagagccacacttgggttttctggcataaccccctcttgtcctcattctcttgtcagatgcaagagtgatagggatgattatccacctccagaccacttggctacctggcaaggcatttgggatcaaccaagtgaacagaaaagagagtttgtatactttacagatggtgccacccccatcacacataatggagcttgccttttattgtaggtggcaccattcaaggtgggcctgtttgtgagcaacagtataattgaacttaaataaatccagaatatcttgcctacagaatccaaaaaagatgtaatggttgtttttcagcccttaatcaggacatcttttatcaaagataggatctacaggttagtacaatttagtgagttttaagcagtcatcttagtactgtgtgtcctggccaatagttgtccccatctatacaattttacagattcttgggttatggtctgttgctctatcctgattgatgactgcaacaattccttaccgaaagttgcacgtttagggtaaagaattgtagagaaatttgttgcttcacaaatacagaaatataaatcaaggacacaaaagccacagtactagatctcattactatgtttcttattccccttaaagttccagactattattgatagttaccaagatacttatttctcctctcaaaatatacaatttacacaattctagttcttgaacaatgcaatcaatagaactttcacctccctttctgaccttaggctatatgccttctttaaagggtcatattggcttaattaaataaggtcaaattcaattaagtgaaacatgccgtattttgttcattaggcaaatatcaagggtaaattaaataaagactctgactccatttttaatgtttggctgcttttcactgctcatagctttcatgcaagccctatcatcctgatcctcttctgccccacatctggacaaatagatgaaagagctcactgatccctgcctggggaagtctaaaccacacaagccttgtctttacataggacccctgtacccttatcttcatgaaagtcaagcaagtttcttttctctactctttcaagccattttcacacagcttgggatcctacactgttcttaccagaaaatctcatggtgtgagtattaaacttactcatctatccgacttctgtggggcaatatttgaatatattgcctgtcttagtccattgtgtgctgttttcacagaatacagttagccctctgtaacttcaggggatttattccaggatcccctcagataccaaaatcctaggatactcaagtcccaaagttgtacttttaagaacctgtggatacaaaatgtctgccctccttatttgcaggctccacatcccatgaacactgttattgtccatccatggttatttgaacctgttgatgtggaactagtgaatacagacggcatactgctccacagaatgggtaacttatacagaacagaaattgatttcctcatagttttagagctgggaagtccaagattgcggggataatatatggtacaggtcttttttactgtgtcatcccatggcaaaaggctaaagagaagagaccaggaggggaatgaatttgtccttttataagggaactaatcccacccatgagggtggagccctaatggcctaatctcttcttaaaggtcccaccccttaataactgttacaatggcaagtaaatttcaatatgagttttggaggggaaattcaacccttaacattgcctattttttaaaattggaggccgggcgtgatggctcatgcctgtaatcccagcactttgggaggtctagatggggggatcacgagatcaggggttcaagatcagcctggccaagatggtgaaaccccatctctactaaaaatacaaagattagctgggtgtggtggtgtgtgcctgtaatcccagctacttgggaggctgaggcagacaattgctttaacccgggaggcggaggttgcagtgagctgagatcatgccactgcactccagcctgggcaacagaatgagatgccgtctcaaaaaaaaaaaaaaaaaattggattgtttgccttattattgaggtataagagatcttttgtaatgttggacacatattttgcaaaactttgttaccagtctgttgcatgatttttttaaaatttgtttaaatgtgttatcttgaagggcaaaaattctgcattttgatgagatccaatctatctcgtgtgtgtgtgtgtgtttgtgtgtgtgtgtgtcacgcttttggtgttttatctgtgaaatatttgcctcaatcaaaatcttgaagtttttctctcatgttatcttctaaaaattttactactttcatgcatatataaaaattgacaacatattttgatgtaattcctgtgcatagtgtgaggcaatggtccaagttaatctctttatatgtagatctacttttattcacccagcagtggtttttaaaaaggttattctttcttcagtgtatttccttttcactttggttgatcatcatttggctgtaaatataagggtttatttcaagactgataattccatttcattgattataaaactatcctatgtaagtagcataccatcttgataactgtagctttatagtaaattttgaaatgagaaagtgaaagtcatctcactttcaaaattgttttgacttttataaaatcaacataaattttataatgatcttgtcatgtagggagcatactgaatctatacatcaattttggggaaactatcatcttaaaaataccgtctttcaatgcatgaaatgtgacatcattctatttaattagatctttaatttcagcaaagttttataatttttcagtgcacaagtcttatacttcttttgctaatttttttctaagtattttattccttttgaaactgctatgtaaagacttcattcttgattctttttaaattattccttgtatgtagaaatgcaattgatcttgacttctatagttctgatatatttgtttgatgtatttgttcttgttacaattttttgagaatttcatagattttccacatacaaaattgtgtcctctgcaaataaagagttatacattttcctttccaatttgaatgctcctctcttggtttttcttgcctgaatgcactgactaaaatctcctgtacaatatttaaagaagtaacgagagtcatcaatcttaccttgttcactttcttagggggaagcccttcatcatttcacaattaagaatggtgttcttataggtttttttgtagatgcttttatcaagttgaggagtatccttttcattccaagtactttcaaaattttactataaaatggtctttgattttatcaattcttattctgtgtttattgagatgagcatgtgtttttccctttattctattgatatggtatattacattgattttcaatcaacattgcattgttgggataaattcaacttgatcatcgtgaataagtcttttctaacttcactccagtgaagtcatctaggactggagtttctttgtgggaagatttcacaagatgaattagattttgttatttgttataggtatatttagaatttctatttcttctcaaatgtattgtagaaatatgtagttttatagatatgtttccatttcatctcaggggtcaaatgtgttggcgtaaagtggttcacagtatttccttgtaattcatttaattactgaagggttactggtaatatcttttatttctaattttagcgatttgtgctttatttcttggtcaatagaggcaaaagttgtcacttttgttgatgtaaaagatacattttttgtgctcttacaatacacagtacttatctctgatcacaaaaatgtgtgtgagtgtttccctacacattagcaattctctagcaggcaacaactgggtgctctataattcaatttaatgctgaattctatctacctggagacaatgtcagatacagcagataaagggctccatcccacaagactgccccctacttcagataccagttgcaagcgctagcttgtcacctatacttctgactaactggatatacattggggttcctatgacccccttcttaagtttgattagtttgctagaacagctcacagagctcagggaaatgcttatggttattcatgtattacaaatgatacaaatgaacagccaaatggaagagatgaatagggtaagatatgtggaaagaagtgcaaaatttccattcttttctcggtgcacaaccctccaggtacctccatgtattttgcaaccagaaagctcttgaaaccctatcctttcagatttttacggaggcttaattgtataggcatcaactcaaccttcagcctcacttctcccagaaggtggggtgggactgaaagttttaatgacatagttcattcttctggcaacaagtgccccccagccaaacctccgttctctgtctccaccaccccttcatcgaccaccatcatgaggctatatataaaccctagctatcattcatctcattagcacagaaaaatatactcattgattaagaaagtccagagattttagaaattgtgtatcaggaaccagggtcagagaaaaaatataaattaattatatgacaatattatagttgaacttttcaaagaaacaacttttattttacttattttcttctattttttaactcttttctatttcattgatttttttactctaatctttattatttcctttcttctgtgtgcctagggcataatttgctcttacttctcaagtttcttgaggcaaaagtttatattattgatttggaatctttattatgggccgggctcagtggtggctcaagcctttaatcccagcactttgggaggctgaggtaggtgatcacctggggtgaggagtttgagaccagcctggccaacatggtgaaaccctgtctctaccaaaaatacaaaaattagcctggcgtggtggcatgcatctgcagtcccagctactcgggaggctgaggcaggagaatcgcttgaatctgggaggcagaggttgcagtgagctgagaccacaccactgcactccagtctgggcaacaagagtgaaataccatctcaaaaaaaaatctttattatgttctaatataagcatttgaagcttcatatttctccctaagaactgctttagcttcatcccatattttttgagattttgtatcatcatttttgtttagttcaaaataatctctaaatttccttgtaatttcttcttgatccacttgttatttagaaatgatatttattgctttctatcagattggtgagtaaacaaataaatgttatttaaatatagaaacatttgagaagtttccaaaattccttctgttgttcagtttcaacttaattctgtttgaattggacaatatacttcagatggtttcaattattattaatttatttagacttgttggatcctgtttttattttaaatcaaatctgacagcctctgtgttttgattccacttgcatttaatgaacatattgatatggtaggacttaaatttgttatttaactatttcttttctatatgtcatctttcttcgttcttttattcctattcccttcttttgagctgaatatatattttccagtgtactatgtacattcatttccacaatatatttagcttcattttagagattgttgtaatgtttacaatatgcatcttaaaacaatctacctcaaattaataacttaattcatgttatatatagaagctttattctaatatagtttccttgtcatccccttctttgtgttattattgtctttctaattatggctctctattatataaataacacaatttttaaaatttgtgttctacagttctcttttaaatcatttagatgaagaaatgttttaaatatatatacatttatttgtaaagtttttttatatttacctactttattgccttccttagtgctttttatttcatcttgtggatccaagatatcatctttcagactgaaagactcactttattatttgttgtaggcagggatgctgttgaactccattttgtttatctaaaaatatatttttttaatgtttaaataatagttttcctggatagcaaattcttgtctgatagtcttactcttttagtatgttgatggaaaacaaaaccaaagtgtaaaatatttaaagaggtttattctgaacgaatatgagtgatcaggtcattcatatctacatatcaaagaagctcaactaatttagaagtatgcactcaaagagattcacaccatagtcaaactgttgaaagccaaatcaaagagaaaagtttaaaaggagaaagaggaaaataactcatcacatacaaggaaatatatgtctcatggtcaggagaacagtctcaagaggacctcagaaagtgtgccaagagtcgggttacagtttggtgttacacattttagagacacatgaacttgagtcaaatcattaatcaatacttggaaggtgtacattcattcagcctaaagagcaaggatatctggaagtcagagcttacagatcataggtggattcaaacattttctgactggcaattggttgaaagagttagactttgtctaaaggcttgaagtcagtaaaagaaagacatgcttaaatggagataagggggattatggaggccaaggttcttattatgtagatgaagcctcctaggtagcagccttcagagaaaatagatggtaaatacctcttttcaaagtttaaaggtgtcagactctcatttaatctcttctagatttgggaaagaactatgatatagtttggatacttgccctcactcaaatctcacgttgaaacctgatccccagtgttggaggtaaagcctagtgggaggtgtttttgtcgtgggagcagattcctcatggcgtggtgctgtccttatgatagagagtgagttcttgtgagatctggtcacttaaaaatatatgacaccttctttcccattctctcttttgctcttggtctcatcatgtgacatgcctgctctgcttcaccttccaccatgaggtaaatctccctgaggcctcctcagaagctgagcagatgccgtcaccatgcttcctatttagccagaagatcagttagccaagtaaacctctttcctctataaatcacccagtctcagatatttctttatggcaatgaaagaacaacctaacacagcctagaaaggaaaagcctggctgcattaatggagattctccacagctgcaaaattattttacaaaagacagctttgcagggccatttcaaaatatttcaaagaaatatattttgggctaacatattttgatttcctttaaaaatcagctatctgtcatgtgatgctatgcagggtcacgttggaatttggtatcttattgccacaaagtcttttgtgtgagtcttatgagctctggagtcccattggcagagaagggctctgttcagttggctgggggcctaggatcttatatttgtttggcaagtctgacatatagtgaacatgtcatctcactgccttccagacaccatagattctgatgaaaaaatcagctactaatcttttttatatttcctggtatgtgatgagttattttcctctttctccttttaaacttttctctttggtttggctttcaacagtttgactatggtgtgaatctctttgagtgcatacttctaaattagttcagcttctttgatacgtaatctttttcaacttatttgggaagtttttggctactatatttgcaaatagtttttccatctctttatcttctgttcttatgggacccccattacgtgtttgtgagtatgcttctttgtgttccacgtgtctttgaagctctgttcattttatcctcattcattcttcttgtgattcctgaatggataaacgctattgatttattttcaagttccctgattctttcctcttttagcttaaatctggttttgataccatctaatgaatttttcacagtacttttttacttttcaaatccagaattgttttatgttttatttatatgattttgttgattatttagtgagtcataattgtcatactttcctttacttctttaaagatactagcatttagtactttgaagatattttaataaatgatttaaattttttctctaaagtccaacatctggcctccataaggaaataatttcattggctgcatcttttttgtgtatggtccatacttttttgtttgtttgtatgtcttatatatttttgttgttgaaaactagatattttaaataatatattttagccatgctggaatcaaaatctgccccctccagagattttttttttgtttcttttgctcctgtgtatctgtttatttgtttagcagcctttcttgggtaactcttcagattctgtatttcttgtagcatacaactagtgagttctctgatcacatctattcattttctttttctttcaacttttgaaaaaagtcactttatataagtatcccctgtgtcaccatagttcagtgcttagccagttatcaattgttaaaggcctcaagtcagtaaatgttctatatcttgcctgggcatacacatagctctctttaagcaaacacctttctggaactccagtatgattatctgtttaccaggtctttctttcaagttttaattaagcaggctattttcatttttgccaaataaaaacacagttttaggcagctacaataactaacaattttatttaattactattgtttttgatagtgccccaaggacatggctttctccacagtgttgaattcagatagaaaaaaaataatgacaacactctaggaatgtgaattttcactgagcttctactgcactgataaaaaaatatttagattgctctggggatgtgctttaattgaattccaaaagaagtaaggttcctttgttggctacaatgctgctgacttttcatggctactgctttactcagctggatatgtgtacaggggtgaggggagaaagcagccccaggtgaaaacaccaacccaggttcatagcttttctgaaataaatgattttcagtttcttatgttcctcttgttaatttcaagagttctgaattttatattgttgctactattttggctgcttttatgaaattcatttagcaaggtcttcagtctgccattgcagaggttttgtttcctccacaaaattttttatttattaaaataactacatgaaaattacataagtattatgtaatatttcttatattaaaactattaattatcctacatactagtacatgcttatttaatggttgaagaaagtatctctatagatagaagtaagcagaagagaggttcatgtaaacatgagctttttactgcaaaaatatactgaccattataaaactaaatatgtaaataatgatagacacatatatctacaataaataacacagagtatacctaataaaaatataaagatatatagacatttcaaagttttaaatacctttttcacaaattaaaagatgcatgtttttcacattttaatatcttcaaaataggatgcatgttaaagttctttgcagtcaaaacttacttgatggattttattatttcttcctaatcatgacatcttgaattctaagaattagagtaatattacttttgacagttatcacatgcatatgtgttcattttagaaaagttagggaaaaataaatatcaaaacaaaacaaaaagttcactgtagtcccatcaagacattaactgttagcatgtgatatttcaatatttcgttctctctcttatacacacatctatacatatatacatacatacacttatatttattatgtatacttatatacacatacatacacttatatttttgtatatatatttatttatacacatgcacacacagacacacagttaacctttgaacaacatggagctgagaggtaccaaactcctgtgtagtcaaaaatctaggtataacaacatataactgggaactcccccaaaacgtaactactaataggatactgttgagtggaaaccttactgataatctaaactgataacctcaacaaaaacttttttgtgttatatgtattatatgttgtattcttacaataaagcaagctagagaaaagaaaatattattaagaaaatcacaagaaaggaaaaatgtatttactattccttcagtggaactggatcatcataaaggtcttcttcctcatcatctttatgttgagtacactgagaataagaggaagagtaatggtgggtcttgtgtgttaggagtggcagaggcagaagaggcagaggaagaaggagaagcagacaaggcgggcacaattggtgtaactttatgaaaatatatcatcatttctgacttctttcctttttcatttctccaaaaatatttctatagagtactgatcctttttccaatattcattttaatctcagtgcccatgtcatagaagggtctatgtcataaaagaaatcaaatgtaatcctgaataatctaagcctttctgccagattgtctagtgttgctgttgtttctggcactgcttcgcttctgtcttcttcctcatcatctggcactggttcagaactcatcttcatcaggccctcttctgttaattcctctggtgtggtgtccattaactcttgaatctctctaatatccatatcttgaaaccctttaccccacaacaccttttttttttaaatttttttgccatatccacaatctctttcatgactttcttggttagctctgttgtaaatcctgtgaagccatgcacaacatctggacacagtttcctccagcaggaatttcttcttgaaggtttgatggctttcatgactttttctgtaacaagaatggtatcttcaatggtgtaatccttgcagattctcatgatgttttctctatcagatttctcttccattgacaattctttctgtagagtaccgcgtgtaatgagccttaaaggttcctatgatttcccgatttctaaaggctgaattagagatgatgtgtttgggagaaagtagacactttgataccgttggtgttgaactcctggggttcttcgtggacaggggcattgtccaatatcagaagaactttacaagtcagtcccttactggcaaggcagttcctgactttaggggcaaaaaatggatggatccaatccagaaaaagagttctccttgtacaggccttcttgttgtagaaccgaagattggcagctggtgattatcttttcccttcaaggttagagggttaacagctttataaataagggcagtcatcaaaataaaacctgactacatttgcatgaaacaacagaaatagcctatctcttcctgccttaagtcctggtgcttgattccctgcattttttttttttttttagaatagggcactttcatttgcactaaaaacctattcagacctatatcctttctcctcaatgattttctttatgatgtctgggaacttgtctgctgcctattggtcagcagaagctgcttctctttttatcttgacattttagaagccaaacctctttctaaaattatcaaactgtcttttattggcactaaatattccatcgttatatccttcaccttccttctgctttaggttattttgggagaaaaaaaaaaaaacccagggttttcactcctgctggcatagctgcagcaacaacttttacaaatttctttttatttttttaactatggtccttacattagattcatttattttgaaatgacaagaaagcacagctacagatacctggatttacggtacatatcaagcaatttaacctatattctggtatgtcatgacttttctctgcatccagggagcacctccagtatcactagtggcacttcatatgtgtcctatggtgttcttcaaggtttacaatattgaataaacaaaatgaaaaatataccagaactgcaagagatcactttttaatgcaaaacacaagttactggagaagcaagctatattttaagagatacttgcaatacttaagctcaccacaatagcaacaggaggtggctacaaaattattacagtattacagtatatagtaaatgataaaatagactagtacctacatatattttatccattcatgacatatctaactttaaaattgttttcctgatatttctatgctatatgtttcattcatctgtgaggtttttttcaaattgtcacaaatctctaacttttttttcaatataattttaaaaatacatatataagtggatccctgaagttcaaacccctattgctcataggtcaattgtatatacacgtacacacacagatatatatatatatatatgtgtatatatatataaaatatatatatatatgtttacaaccattttagctgcagaaacccaattattctcatgttccttagacaaattttttagaaatgacctgagatatatggccattttgaagtaaaatacctatatttcattaaaaaattcaaacaagaaactttttactcagttaacatttgccaggtacgttccttctggtactgtatgaagttcactaattctttagggacaatgcattagtcctctattattgaaggtttcacttttcataatttcagttacctatgtcaatcttcatctgaaaatattaaatgaaaatttgcactaataaacaatatattttaaattgcatgagttctgagtagtgtgaagaaatgattaaatctcatgccatcctgctccatccagcctgtgatacgaatcgtccctttttccagcattgttcatgctgtataagctacctgccctttagtcacttcataggtttcttagctatcagatcaactgttgacttataggaaaacttttgttcaagtaatctttattttatttaataatggtccccaaatccagagtagttatgtgggcaattaagagatgctaaagagacaccatgaagtgcttgcattaagtgaaaagatgaaagttttttattgagtaaagaatgaaaaaattatatgctgaggttgctaagatctatggtaagaatgaatcttctatccatgaaatcttgaaaaaggggaaaagaaattcatgttagttttgctgtcacacttcaaactgcaacagttatagtcacaatgcatgacaagagcttggttaaaatggaaaaggtattaaatttgtgggtggaagacataaaaacagaaaatgtgttcctattcctatccattacagcaacatgttctatcagaaagctttgagcctttgtgaagactagcaaggaatcccctgaaatggagtgacactatgccatctactgcaagtaatggaattgtaccacaaattcagaaataggtttagactgaaaaatataaaatttactggagaggctatgtctgccaatgaagaagctgtgccacatttctggctgaggcgaagattaaggggaaacaatatcaaccaaagcaaatattcaattgtgataaaattacgctcttctggaagaagatgcccacagaacctaaattcatcaaggtgcaaagtaggcaccaggtcataaaacatggaaggacagatgaactatgtggcaacagtgcagggcatatgataatgacaagcatagtgtagaaagcaaaaaatttacacactgtaaaaaattatctgtgcatgttctggcaacataatctgaaacagacatctagtttatggaataatttcaccaatgtttcattccaggtgtgaaaaaatacttgaaggaaggataattagaatttaaaatccttttactaataaacaatgcacctggccagcctgaatctgttttctaccaaaatgaaaatgttgaagttgcatttttaccttcaaatacaaccccatttattcagccccttgaccaaggagtcatttggtttgccaaggctacatatacacctgcctggtatgtgattgcgttagatcagcaattgaaacagaccttaatctatacatagtgcagtactggaaatcactcactactgctgaggcagtaacattcatcaaaactgcaatggatgaattaaaccagaaactgtaaatgcctgctggatgcacttacagagtgaagtcatgaataattttaaaagtttcccggccaggcgcggtggctcacgcctgtaatcccagcactttgggaggctgaggcggggggatcacgatgtcaggagtttgagaccagcctggccagtatggtgaaaccccgtctctactaaaaatacaaaaattagccaggcgtggtggcatgcacctgtaatcccagctactcaggaggctgaggcaggagaatagcttgaagccaggaggtggaggttgccgtgagccaagatcgcgccactgcactccagcctggacgacagagcgagactccatctcaaaaacagaaacaaacaaacaaaacaaaacaaaacaaagtttcccagagttgacgaaaattagaagaatcattcatgtggcaataaaagttggtaagaagaatttgccaacatgcttgatgcagaagtgggagaacatattgaacaccatctagtagtattaacaggggacaaattggaagagcttgttgagtcatctacagagaaagagaaaaatgataaagaaagaactaaagtagaatcgtgaatgcagacatttctaaaattggtccaactgtcttgaattgctagattaaagggaaaattatggaatatgattcttggatgcagcatggcattaaattcacccatatggtcagagaaggattacaacctctgcagcaacactccgacgaattgataagaaacagacatcaacgtcaaattacaacgtttctcctaaagctatctgcaaaaattcccttaaacaggattcctaattatcgatattgtcttctgctgatatccagccatcaacattgtcatggcttgatgatccaggatcacccaaagcagatgatcttcctgaaatagcatcggaaggtcaataataacttaatgtgacaccacaatgcctacatcattcacctcacttcatttcaccaagtaggcatttgtgtcatcttacattatcacaaaaagaagagtgagtacagtacaataagatattttgagaggggagagagaccacatttacataacttttattacaatatattgttataattgttttattattgcttatagtacttaatctcttactgtgcctaatttataaatgtaacttcatcataggaaggtatgtataggagaaaacatagtacatatagtgtttggtactatctgcagtttcaggcatccactgagggtcttggaacatatccttattgataagggggcctactatacattgccaatgcaggggctgttagcatccaatatacagttaataacacatgtaaggggaaaatcaaaattaagtcctggagtaattcccagtctaaatcattccaacattactttaatgagatgtttgtgtgccaaaattaatgttaaaatataaataaggccattttagaaagacgccccagacaagtttcaagattcaagtcactaaatgaaagggtctcaatctttctaatctgcataaggataagccatatcagcatccattgggttaaggcttttaaacatatattttaatatgaaaaggttctttcttttccttttccctactcttcagtactaaatatagagacctttgtcagacacattttcataagttatgatcaactctcatgttgcaaatgcaggataagagaaactgttctcttttggtctgatgttagatgcctgccaatgaagagtcccctaagtttcctctgctgtgaataacatataagaaggtgtcaaaagcagtgaaaattttctaatggagtcttccagacaatcacaatggtgattatttacatcgcaaaaaaaatgtgtgctgtttcttgagatcgaataagcagaatagatttatttttgcaattacctacaatttgataaacacagataaatattgcttagaaaacacattaatattcttaatctaatcttcattcttctataaatacatctaataatgccttgtattgcatactcttctgaaataaaatgtctgtctcttaattaggatgtgtataatggcagctctgaagacattatcctgacatagaacattacagaaggatttgaaatataatgtagactgtatatatttcataaacaatgcatattcatatatataaaatttaatgtgtttattgataaaaaagaaatatatctaggaagaggaaatttattttagagattattttattcactcacaatagaaggtgacaaataactttttcacataatttttgcaaaatgtgctgtattacaagcacctttgagaggagcattgaatgcatattacattttatatacattgtaaaatccacctctcatcattaaaagccaaaacttttcaaagtagttattgaagaccaaaactatttcctgtggaacaaacaaagcattaaattaaattaagttccttttttaatgccatattggaaactttggcaaaaatataaaggatcaaatttaagacagtacaaatgttacttaaaaggtaagagcaagcacctctaaacagtaaaatttgtttcctgaatatgaatttagaccatgttagatacgagtgagaatagtctgtgagagatttgcactcttactagatcagatgttttgcacatgctgttgtagtgggcgtctagtccaagaaactcgctgaaggacgcgttaaaatttttcatgagaattgtagcctatctcccttaagtacatgtaagactgagaataagaagttttcacaagggtgtgctgagggagcacagagttgaggagtgaagatacaggggagcattgacttgagattaagtatttctttctttagttaaaaaatttgcatgctaactcttaaaatttgtttgaatacaagtgagattacttggttctccctgcaatttctagtaactctctttagaataagttaactccaaaaggctaaaaatggtgataaaagaaacaagagtacttcattctgtaatcaaacatccatgacttttagaataagttaactccaaaaggctaaaaatggtgataaaagaaacaagagtacttcattctgtaatcaaacatccatgacttttaagctcatctcacccctttcacttgtatttattctttatttctggctctttacctttcaggtaaatagtagggttgcacttatatatctcttttaaatttggacatgcactggtgacttgttttggccaaggacatataagatgaattggcatgggtcactttcacatggaaattttaagagccagtaagtgaatgtgtgtgtgtgtgtgtgtgtgtaacttcaatgaactgaagtaacttgctgcaaacacatgagagtaacatgctgctgtcatatgtttgcagaatgttacttcagttcattgtgcaaatttattttagttcatacaattctcttttctatatctcttcactcttagtctcacaagcgtcactgtgatgtggcaggacatggtagagtggggtaaattgacatggtagtgtggggtaaattccaggagctgagaccttctctgcctttcttctttggggtcttacgatctctccactgttctttctagaggacaagaaaaggtctcacaaatcagtcagggatcgagacacacaccgtctagtctcagagcaagaaataagacataggaatactatttcccagaaacaatttttcccctatgctttctgttccgacataattttatgaaacaaatattaatggtcaaagatcataaatgcatgaatgagggttagtatcaaaaaaggggaaagaaatagcagggtgaagaaaataagcgtgagtaaatatattaaatgtattatagagatatcaatgggcacaaagtaatggcttcagctaagctttcagctacctctctgatcctctgttctctgtctccatttttgggtatttctccttccttccactgcagatacagaagttttgtaggatctctttttactacatattcttatttcaatgtgctcattttaaaatattttattttgaagtaaatttatactcaagaggccacaaattctcatgtgttcttcactctgatttcctcaatgataacattttatatatgttcatttttgactactgcatcttgtttcattattttacatattacccttaggcagacccaagtagagtcctgccacatttggactttttaatgataatttttgaagtctgaagtcagattttgttttgactatagtcactgcttctacagtgtcaccagttacctgagatatactactagaatggacagtgaagcagtctcttgactgattgtttctcatcctcatatcatccttaaccttctcaaattctattaattttacatttttttttaccagtgacaaattcatcttcccaaaacatacctctactcttatcattttcttgcttgaaccaggtagccatacaacacttcttaatttatttccttttcttttctttacaatttcacaactaatgctataaaggcacacttaattgcaaacagctggggaaaccatccttcttgtctattcatatatttacatggaagaacattgattaggacaacacccatgtcttctctcaactttctgaaccacttttctccaagagagcaggagaaacttctcatttgtaatctcaggaggaatgattatacatgtttgacatagccccgttttgctttgtttgtggaagctagctttctacgggaagcgctcatttgtgtttaacatcatatatttaacagttttgaaaatattctttctctatatttcattctaaaattttttctctctgaagtgattcatacaaatattaactgggtgtatggagttccaggatcaagttattttgttgagacaattaaattaaattcatttaatctacttactctacaagcttcttcctactgatttttgacttctgtgactaatagaataaaacatacaggaaattacagttctcttcctatgcctttaaatcactttaaattgctttaaattgggagtgtatggaactcacaggtttttcctacatattgttggaagcctttctgaaaaataccatttatagtaagaaagactgtcgctgatgtgtactaacgtgctcaattgtatgcaagtgtggaactttggaatagaagtgggtaactgacaagagaacgggtcctgccagagaaaaaagaataatgagtatgataagaaaggacaagaaaatgtacatgtatatctgtgcctgacttatttcacttagcatagtgttctccaagttcattcatgtggttgcaagtgacagaatttccttctttatcaagactgaatcgtaaattatatacacataccacattctctttatgcattcattgactgataagcccttagtttgtttccgtatcttggctaatgtgaataatgccacaatgaacatgggagtgcaggtatctctttgacatactgattttaattcttttagataaatatccagaagtggtactgctagattactggctaattgtatttttagttttttgagaaacctgcacaatgttcaccataacaattttacagttgcattctcaccaacagtgtatcagggttcccttttcttcacatcctcaccaacacttgttaactttcatctttttgctaggagccattctaacaggtgtgaagtgataccttgttttgcaactttaatttgcttgtccctggtgattagtgatggtaagcattttttaataaactttggtcacttgtatgttgccttttttttttggagatggagttttgctcttattgcccaggctggagtgcaatggtgccatcttggctcactgcaacctccacctccttggttcaggtgattctcctgcctcagcctcctgagtagctgggattacaggcatgtgccaccatgcctggctaattttctatttttagtagggacagagtttctccacgttggtgaggctggtctcgaactcctgaccacccgccttggcctcccaaagtgctgggattacaggtgtgagccaccgcacccagctgtatgttttcttttgaggaatgtctatttaaacctttgctaatttcttaattggattattttccttgctattgagttgtatgagttccttagtttggatattaaccctttaccaactgtatggtttatcccacttatgtgtgtaattgaaaaaagtcaaacttatagaactggagagtagaatagtagttatcaaaggttggggaaatattgaccaaatggtacaaaatttcagatagacaggaaaaataaattattgaggtctattgcacagcatggtgattatacttaataaaaatgtattgtgtattttgctagaagaatatcttttaaatgttctcaccacaaaaaaatgaaaagcatacaaagtgatgggtatgttaatttgtttgattaatcataccaccctgtatacaaatatatcaaaacatcacattgtattccacaaatatatacatttatttttaaaatgtgtgctagtgaaaaaaaatatatcatctattttgtacctgtgagagcaagttcctttggtcatggatcccaactatttttgtagtgccagaatagacactgtgggcaataggagaccttgtccagtcaagtcctctttatatttctgaaactcttactttgctgtcctattattatgcatttaatcttggaggaagtgtaggagggtgagtatgggtgagttggtatgtatagaacgttcctgtcatttgacagtcataaggatcagtatttaggcttatttccattgaggtttgatttttatgtatttacttcttttgtctcagtactcttaatgtggaactaagcattgggatgtaataatagggagtcttattacacagagcttcttcctaagctgcattcttggtctttgaatttattttgcatattaagtttttctaacagcttgtgggcaatggaaaacacttttgagggacccagagttactcagcttctcctcttgaagatcttctaaaacattttcattctcattgaattaaaagtgcttttcaactgtattctaagggtttttctggaagattaatacacatatattatcaatgaactctatggtcaatgtacatgaatgcatttcggagctgaatttccagaaacagttttctaagtaatcttataaactacattttattgcaatggcttctgtttcttagactttctcataaagagaaaataatttgaaatttatcatgcagaaattgtattacagtagtcttaggacacataaaatgagacagtataagacatataaaggattgctatagttaggatttaaaatgcatgaactataaatcttttcatgctcaaatttgaggctacttccatgatagatgctcaataaatattggttgagcattgatttccccttctgagtcattcttcctgttctataaaacatatgccatgttttccatactgtagactttccagcctgtctctacccatggacgtttgctggtataattgtctgttttcattgtgtatttgctcactctttcagtacaaaatgatatcaatgcttaaaacaaaagtattggcttctgatgtacctatttttaatctgtttcattaaacaaaagccatactgactattctcttgggttcatggtgagactgctgggagacaaccaccttatgattcctagaagctctattgtttaataacattctattcatcagtagtgagtcaataagatcagttcttattctaggaaagaggactaaaacttcaattatgtacaagtgaagggccaaagaatttgcaaatatatttagaatgtccatgccatgaaaatttaattttgttttcaattttttttgcagacttaattcagattgtagataagttagaatatctaagttagcttgattaaaaagtaagtaaaatattacattatttattttgaaaatttagaaaattgagtgaagtgtgtcccagtttcttatcaatctttcatcttgggatgttaggacaccaatgtattggagatgaaatgagaaactatatccggaagagttatataactaggaacattttataaaattatagtatagaactaccatcagcatcaggaagaatcttccttaattggttgtaatcccatactaaattgactatgctataataaactgcttttccttgaaagacaggaataatcattttttaaaatatattttaaggctattgtaatgagaagttttgctttcctatgaattttattttattctttctgtgtcctaatttttcttaacctgaagtgcaagacatgaatgtcatctagcactatctgcatttaaattgtgaccattttattaattatagcttttggtaaaatcacaatataataacattatgaaatctttcacttctttgtatagtaccagcttttcttaatgccaattaatgtatttaatcatgtaaatttatttaaaaataactaaatttgtacatgactgtcacattatgaactccaaatataatttcactgaaattatttttcactctaatatttgaatttcatggaaattacatggtcattaccttcatctcctggccaataatctctagcaaataaaaatgttaataaatgtgttcatgtagattttagctatatagttacttttgtgctgaggtgtaaaatatctgggtaatgaaaatatttttgtttgtttgtttaaccaaagggcacaaagataagttagtcaattctatagctgatagtgaagacatctttataacaaaagtttcttaagttaatcgcttagcatactcaaacaactttagccattttccactttccttcacactcattctaccatttccagtgatcattttgcttttgatcaatgtccagtagtccgaaacctttccagtaatgcttattcaagtgtgtttcacattaatgatcttggtctgctagaaaaccaattacacattcttacatttaatctcggctctgtaatggatagtgttttccttaaagatgtgccagcggtggattgtcgcaagcacagcagcacacaaagctgtgattgctttaagaaaaatggtccaagcaagacgttacataaaaactctggaaatcaatcaaagtagtgaagtaatttgtcattattttcttagctttaaaaaagtgtatttacttttgctctaaaatctcaaagacagactgtgtatgttatctaaggagagtaagttaaaaaatatatattccatgtgtttttggaaaaaatcaggcaagattatgagacaaaaatcaatcttcatttttaattaaatgtctaatatatgcataagactgcatcatgacataaataacactatttgaattatgtggagaagagaatatttatagaccttaagtaattataattattttgaaaagatacgtagacattaatggctacctccgtgagaaagcagttagaaatctggaagaaaagaatgatttactttccttttcataccttattgttcttacatatgcttattttactttatcatttaaaaccctatttaaccaaataacaaatattgaatcccaaaccagttgatctttattgtgttaatacataggaaatcattaaaagaaaaactttagatgaattaaatttaagagtttaattgagcaaagaacaatttgtcaatcaggcagtcctcagaaccggaagaggttcagagaattctgctccacaacatgggctggcagcattcatgaacagaaaacaaaacatgaggtagagaaacaatttggttagttacagctccacgtttgcctaatttgaacatggtctgatcagttggccacctgtgcttgacctaagcttaactactgtgattggctgaggctcagctatttgttacaaaagtgtagtcctaaagtacgctttcagttagtttatgtactaagttaggttgcagtttttacataagaactcacaatatgaaggcatcctcaggccaaatttagtttaacagaataacgtactgctatcaacattaaacatagctaaataattttagagaattattactcaggattgtgaaagcacagaagtagaaattgactaaacaaagtataggggccaaagtatttggtacataagatacctcaatctgtaggacattaaaatatctaattctttctgagaaaaatattccattggaccttagtcagtgaaactggtactggaaaggctacacctttgaaaataagaaagatacacacattttgagtcagaacagtcttctaagcatctatattgagttcatggcaattcttcagtggtctctctttactaacagaaatctttcaaaactaaaattgagaaaaataatattccatgtgcatgagatttcttctatgagtagtatttatgcatcttagaatttgaaataatgtgaaatgtagttaatttagtgtatatttatgttaaatatttaagaatctgtgtgacagaagaaagttatactcttttacttgtatttatttttaattttttctatcttataatgtattctaagtatgttaattagtagcatttcttttctttttttttcttttttctcttttttttttttttttctgagacagggtctagctctctcactcaggctggagggcagtgacgtgatctcagctcactgcaacctccgcctccaaggatcaagcgattctcatgcctctgcttcctgagtagctgggactgcaggtgcatgccaccacacctggctaatttttatatttttagtagagatggggttttgccatgtttgccaggcttgccttgaactactgttctcaagtgatctgcctgcctcagtcttgcaaagtgctgtgattacagaagtgagccactgtgctggaccaattaatagcacttcaactgaaacttataataaagtttctgatatcctaaaatctgaaacatttagtttctctgacatatcttacttcagaccctggtgcttcactcgtgtttttctattaaggacttctatacaaatgcttatttatcaaatgcatcaatttagaataaaatatctataaattaataattaaatattttaagtatatctgaaaaacatattaagaccttagacaaattactatttttaaaagtatttataattctcttggctgactggccaataacagttgagttcttaccttgaatgaagccttgtgctatatgctttgaatatatttttttcattattcctcacaacaaatttagtttgttgtcagtggggcagttcaggttcttgacggctgcataaaagtatttgagagcgggtccaaagtgaaagtaggtaaagaagtttatcacaaagtgaaagtacactctgacagcttatctaagcgggcttctcaaaagtgaaagagcactgacatggggaaactctctttatgagagtcttacataattattcatgaagggatgggaatgagcattgctgttaagtatgttgtgggtggtctcctggatgcacatgcgctactgctgtacatgctagtacgtacattgcatgtctcattagcattttaattctccacccagaggtgtggggtttttaaaaatttaattttattttaagttccagggtacatgtgcaggatgtgaaggtttgttacataggaaaacgtgtgccatgatggtttaccgcacctatcaacccatcacctaagtattaagcccagcatgcattaactattcttcctgatgctttcctcccactccccaccacccaacaggctccagtgtgtgttgtttccctccccgtgtccatgtgttctcatttgttcagctaccacttataagtgagaacacgcagtgtttggctgtctgttcctgcattagtttgctgaggataatggcgtccagtcccatccatgttcctggaaaggacattatttcattcctttttatggctgcatagtattccatggtgtatatgtaccacattgtctttatccagtctatcattgatgggcatttgggttgattccatgtctttgctactgtgaatagtgctgaaataaaaatgtgtgcatgtatctttataatagaatgatttctactctgttgtgtatatacccagtaatgagactgctgggtcaaatggtatttctggttctaggtctttgaggaattgccacattgtcttccacaatagttgaactaatttacattcccaacagtgtaaaagtgttactatctctctacagccttgtgagtatctgttgtttcttgactttttaaataatctccattctgactggcatgagatggtatctcattgtggttttgatttgcatttctccaatgatcagtgataccgtttttcatgtttgttggctgcataaatgtcttcttttgaggagtatttgttcatgttctttgcccactttttaataagattgtttgttttttcttgtaactttaagttccttgtaaactctggatattagaactttgtcagatggatagattgcaaaaattttctcttattctgtaggttgtttgtttgttctaatgatagtttcttttgctgtgcagaagctctttagtttaattagatccagtttgtcaatttttgcttttattgcaattgctttgctgtttttgtcaagaaatctttgcccatgcctatgtccagaatggtattgcctatatttttcttctagagtttttatagtttgggattttacatttaagctctttagtttagatcccagctgtcaattttggcttttgttgcaattgtttttggtgttttagtcatgaagtctgcccatgcctatgtcctgaatggtattgcctaggttttcgtctagggtttttatggttttaggtcttatgtttaagtctgtaatccatcttgagttaatttttatagaagatgtaatgaaggaatccagattcacttttctgcatatgactaggcagtcctcccagcaccatttattaaatagggagccctttccccattgcttgtttttgtcagatttgtcaaagatcagatggttgtagatgtgtagtattatatctgagttctctgttctgttccattggtcatatgtctgtttttgtactagtaccatgctgctttggttactgtagccttgcagtataaagtcaggtagagtgattcctccagttttgttctttttgcttaggattgtcttggctatatgggctcctttttagttccatgtgaattttagttccatgtgaatagtttttttctaattctgtgaataatgtcaatggtagtttaaggggaatagaattgaatctataaattgcattgggcagtatggccattttcatgatattgaatcttcctatccatgagcatggaatgttttttgatttgtttgtgtcctctctgacttctttgagtagtggtttgtaattttccttagagaggtccttcacctcccttgttatctgtattcctaggtattttattctctttgtagcaattgtgaatgggagttcattcatgatttggctctctgctagtctattggtggtgtataggaaggctagaaatttttgcacattgattttgtatcctgagactttgcggaagttttttatcagcttaagaagcttttggactgagataatggagttttctagatacaggatcatgtcatctgaaacatacacaatttgacttcctctcttccaatttggataccctttatttatttatcttgcctgactgccctggccagaacttccattactatgttgaataggagtgatgaaggagggcattcttgtcttgtgccagtttccaagtgaaatgcttccagtttttgcccattcagtatgatattgctgtaggtttgtcatagatgactcttattattttgtggtattttccttcaatacctagtttattgagagtttttaacacgaagggatgttgaatattatcgtatgttccttcaatacctagtttattgagagtttttaacattaagggatgttgaatattatcaaaggccttttctgggtctattgagataatcatgtggtttttgtccttagttctcaatatgtgatgaattatatttatcgatctgtggtttgttgaactaaccttgcatcttggggatgaagccaacttgattgtgagtgataagctttttgatgtgctgctggatttcatctgccagtattttactgaggatttttgcattaatattcatcagcgatgaagttttcatttttacaatattcatcagtggtttgaagttttcattttttgttatatctctgccaggtttttgtatcaggatgataccaaaatgatttagggaggagtccctccttttcaattgtttgaaatagtttcagaataaatggtaccagctcctctttgtacctctggtagaactcaactttaaatccatctggccctgggcttcttttattggttggttggctatttattactgcctcaatttcagaacgcattattggtctattcagtgattcaacttcttctcggttcagtcttgggaggatgtatgtgtccaaaaatttgtccatttattctagattttctagtttatttgcacagaggtggttatagtattctctgatggtcatttatatttctgtgggatcagtggtgatatcccatttatcattttttattgtttctattttattcttctctcttattagtctagctagtggtccatctgttatttttttttcaaaaaatcagcccctggattcatttatttttagaagggtttttttgcgtctatatctccttcagttacactctgatcctgcttatttcttgtcttctgctagctttggggtttgtttgctcttggatcgctagttcttttagttgtgatgttaggatgtcaatttgagatctttctatctttttgatgtgggtacttagtactataaatttccctctgaacactgctttagctgcatcacagagattctggtactttgtctctttgttctcactggtttcaaagaacttcttgatttttgcccttatttcattatttccctaggagtcattcaggagcaggtttttcaatttccatgtagttatgtggttttgagtgagtttcttaatcttgagttcaaattcgattacactgtggtctgagagactgtttcttattatttcagttcttttgcatttgctgaggagtgtattacttccaattatgtgatcaattttagagtaagtgccatgtggtgccaataagaatgtatattctgttgtgctttggtggagagttctgtagatatctatcaggtccacttaattcagagctgagttcaagtcctaaatatttttgttaactttttgtctcaatgatctgtcaaatactgacaatggggtgtgaaattctcccactattatgatgtggtagttctctaagaacttgttttgtgaaactgggtgttccatgtattgggtgcatatatattcaggatagttggctcttcttgttgaattgaacactttaccattatgtaatgcccttctttgtcttttttgatctttgtttgtttagtctattttctcagaaactaggactgcaactcctgcttttttctgctttccatttgcttggtaaattttcctccatccctttattttgagcctatgtgtgtttatgcatgtgagatgggtctcttgaatacagcacactgatgggtcttctctttttatacagcttgccattctgtgtcttttaattggggcatttaatccatttgcatttaagggtaatattgttatatgtgaatttgatgctgtcatcatgatactggctagttattttgtggacttgttaatgtagttgtttcatagtatcattggtgtgtgtcattcagtgttttctttttttttttttttgtaggggctgataatgttttctgtggtggttgttgttgtttttcttccatatttagtacctccttcaggaactcttgcaaggcttccttcaggaactttgaagtacttccttcaggaacttagggttaaggtacgtgttaatagtcaacagtaccatgtatttatatgtattcatttgaaagttgaatgtatcattcttgagtgcagaaattattgctcaaataggtttttgatgtgttggagatactggggtaacaattcagaagaagtctttataattatggtacatatataaaatgtttataatttcttgagtatagtgtattatctcagaataattcagaatgtttctaatttaacaaaataatttgaaatatttatcattgttcctttcatttcagtttgcttttttctgtaacctgtctattcatcatcatcataagtaatataaacataaaacagataaccacaaatgtataagattgttatataatttctaaacacattgatttcccttcagattcctaattacatatttcaaaaacacaatgtattgatattcctttattacattttaactctaaaatctgttccctatagtccactgcttgctcatactatcatgaaacatttgtatagaaaacagatcacctataacatgagcaaataattgaaagcttgaaatacatttcaagaacctgctttaatctgtaagcaagaggaaagagttcaagttccacagctaggcaatggaaaacaaacactgttgtatcattttaaaatcaaatattggaggtgaattttagaatataattcatcttactaacctaacacaataaagtctggggtaaaaatatcttaacacattttaaatatatttttcatacaaatgccttgaactttttttgtattttgtgtatgtgtaattgacatattccatctttataaacttaagacttgctctaattgcatacaataagagcctgcaagagccagtggttacaaatttgtagtcagcccaaatcatgtttagtttccatacaaatgctcttaacttttgcatattttgtgatagtaaacattatcttcataaggcattttattaaacaaataccagtatttgtttaaaatattacacaaaacaggacaataaatattaattgcagaaagaaccatctgcgaaaacaataaaagtttatgctaatattgatctagaggaaaataatgattttttaaataatttcaacttctattttagattcagggggcacatgtgcaggcttgttacaagggtatatcgtatggcactgaggtttggggtacaaattataccttcacccagatagtgaccacagcacccaataggtagtttttcagttcttgcctcccctccttctctccctcttctagtagtacccagtgtctattgtttccatctttatgtctgtttttatacctgatgttcagctcccacttataagtgagaccatacagtatttattttctgttcctcaattaatttgctttagatagtggcctccagttttatatatgttgctgcaaaggacaatattttgtttgtttttgtgactgcatagtatttcatggtgtatatgtaccacattttcttgatccagttcattgctgatgggcacctaggttgatttcacgtaactgttattgtgaatagtgctgaaatgaacatatgagggcatgtgtccttttggtagaatgattcattttcctttgggtatgtatccagtgatgggattgctgggcgaattgtagttctaagttctttgagaaatttccaaactgctctccatagcggctgaactaatttacatttctgtcaagagtgtataagtgttcctttttcagtgtataaggttccataaccttgtcaacatctgttattttcttcactttttaataataaccattctggctgttgtgagatggtatctccttatggttttgatttccatttatctgatgattagtgatattaagcatgttttcatatgcttattggttgcttgtatttcttgttttgaaacatgtctgtttatgttctttgccaagtttttcatgaggttatttggtttttgcttgttgatttaagtcacgtacagattctgataataagacctttgtcttatgtatagtttgtgaatatttgctcccattctgtaggttgcctgtttactctgttgattgtttattttgctgtgcagaagctccttagtttaattagattccacttgtcaattttcattttggttgcaattgcttttaaaggcttagtcataaattctttcccaaggctgtgtgcagaatggcatttccaaggttttcttctagaatttttatagtttgaggtcttatatttaaatcttttatccattttgaggtaagttttgtatatggagaaagacaggggtccagtttcattcttctgcacatagctagccagttatcacagcaccatttattgaatagggagtcctttccccattacttgttagctttgtcaaagaagagatggttgtaggtgtgtggttttatttctggcttctctattctgttccattggtgcatgggtttttgtagcagtaccatgctgttttggttaccatagccttataatatagtttgaagtcaggagatgtgatgcctctagctttgttctttttccttaggattgctttggctattcaagctgttctttggtatccatatggattttagagaagttatttttttttctaattctgtggaaaatgacattattattttgataggaatagtgttgaatctttaggttgctttaggcaatgtggctattttaatgatactgattattctaatccatgagcatggaatcttttttccaattttgcggcatctatgatttattttggcagtgttttgtagtcatttttgtaaacatcttttgcctccttgattagatgtattcctaggtattttgtgtgtgtgtgtgtgtgtgtgtgtgtgtgtgtggctactggaaatgcctattgcattcctgatttggctttcatcttgatcgttattcatggatagattttggtatgttgtgtctctattttcatttatttctaagaattttttgatttctgccttaatttcattgtatacccaaaagtcattcaggagcaagttgttttatttcaatgcaactttgtggttttgagaggtcttcttgatattggtttatagttttattcccctatggtccaataataggtatggctggcatgattttcattttttaaatatttattgagacttgctttatggctgggcatgtggttgattgtagagtttgttctgtatgcagatgagaataatgtattttttgtggctgttggatggagtactcttcgtctctttttttaagtatgaaatttggtttgcacatatgcaaaaataaaaatttataaaatatctaaaaataaattttaaaaaagaataataaatatgtgttcatattgtgtttatcaaattattaatcagataattatactaaggtgatttttttaaaaagcaagggataaattagctaaaccttaattatgtgttttgagaagtgtaaaaaaaaatgggctagatgcagtggctcatgcctgtaaactcagcactttgggaggcaggggcaggaggattactggagaataggagtttgacaccagcctaggcaacataacccagtctctactaaaatttttttaaaaatcagctgagcatggtggcacacacctgtaatcctaactactcaggatactgaagtaggaagaccccttgagcccagaagttccaggttgcagttagctatgattatgccactgcactccagcttaggtgatagagagacaccctgtctattaaaaaaattctagaaagggaagtaatgaaatcaaaattgccttatcaggtattcaaaggtaaactaaaactacaaataagagtgtagcactggtttacgtgtgagttaagagagattaaaggtacctaaaatttgcaaaagtagatagaaagcatataggtagcataatgatggtacattgtataataaatcattgggactaagataaatatagatgcaccaactaagtagctatctaaaattaaaatattttatcactgtaacttccaaatatttaaatgtaaatctgaaacaaaaatattaccaaaagtaatgtatttataatttcaaagccaaaaaagctacattagaataaaactaagaaaacatcaaaaaatgtatatatatatatgtgtgattacattaaaatatgacatgataatgtcacatggcaaaaatatagtaatgtcaaaagtcaaacgaaaagtgagaaaaattcagtccttatttcatagaaggacctgatatatttttataaagaaaatcccacaaattaattcaaataatgatctaaaagcaagaacaaaaacaggtttacagagaacagaaatagatatggctctttggtataaaaattaattctcagtattatgtacaagaagacaaattaaattttcagaaacatgtcctgctttgtccctcagactggcaaaaattattatgctgaattgtgttactgtgataaccgtaaattatggaaatatgttgacaagcagatgaaaaaattttcactcaaaacactgcacatagtattaaaaatgtgtgtaatatcttctaaaggcaatccccaaaaataacaattcactgtccatttggctcaagtcacccttgtctaggaatttatcctatagaaatatgtgcaacttcatgcagtcattccttacttagcataaaaattgccaggacaaaatgtatggttgtgtagcttatgcatggcaaaaacagggttggtagatgattaattttatacatcaacctgacaacaccatgaggtgtgcagattaagcattatttctggtcatgtctgtgacgacatttctgaatgagattagcctttgaatcgctggactcagtgaagtagatggccctgcacagtgtgggtgagcatatccaatctgttgaaggcttgagcatagcaaaactactgaggaaggagaaatttgtgtctttttcttcctgcctgtctgcatcacctggaatattggctatgcccttggtctgggatttatactacgagctcccacggtcctcaaaccttgggactccaactggaataatacaccagtttccctgagcctccagcttgaagacagtagattgtgagacttcatctccataactgcatgagcaaattcctcacaattaatacaaataaataaataaataaaaccattttttccccctctgaaaaactctgaataatacaattgggcaaaagaaaaataaaggctcatatacagatgagccagctatatagagccagaagaagatatgcctttttctaaataatatgcaaaccgttaacaaggcaggggagacctaaattctttcctatggggaaaagaggggctgagaaatacaaattttattctggtgggacagaagtctactcaaaaattaattcaagtactaggaaaaatctttaacaacgggcattattttgaaaaattttattgttctacaacctgatattactaaattaaacttagggaaattggacaaaataaagttaaaggtatatattccaaggttgggtaaactatacataatctaaaaatattatcctatttagcaaatattttaacattgacactattttctcaagttgaaggtttcatagttaaaaatatgtactttgaaatattatcagttctctaatagcatcagtttctgaaggttttcattttttatttttagtcaatagaatagcaactgaaaaatacttctttatactttataatgtaaatattttataaagttgtttgaagtttatagtagtagttgtatttttagcaaaatatatttaatacttgtggaaaatttattgtcatcatggatattttaacatgtataaacttataaatttatattttaaacactatacatttctgagtgttaagtctaattcaacaaacatgttttgagtcatttaggtctggtgctaggtaattggcataaaaagccccaaatgaccagcatctaatttcaaataagtcaatgctgacatgacgaattccacttttgtttttactatactggcagtcaaagctctcagaaattgataatgtagtccaacatcaataatcatcgaagtttaatatttaaatgccaattaacttataatatcaagaatacaagaggataaatagaaaagatgaattcaaattctatagaaagtgtgactatacatcaaaaactatacatgtttaaaccaataaagtatctattattttatacatttttacctgttatttgaaagtatatagttttggcagtttttctgtggattccttaggggtttctatatataagatcatataatctgccaacagggacaattttacttcttgcttatttatttgggtgccttttatttcttttcctttcctgattcctatgctgaatagaagtggtttgagtaggtaattgtcacctttcactctgttaaaatggtgtagcaaattaatagatttttgtatggtaaaccacccttgtgtcctaaggataaatcccatttagccgtagtgtgatccttttaatgtgctattgaatttgatttattactattttgttaaggaattttgcatgtctaccagggagattgtcgtgtagttccagcactttgggaggccaaggcaggagaatcacttgaggctaagagtttgagaccagcctgggcaacataggcagaccctgtctccacaaaaaactttaaaaaccattagctgggtatggcagtgcatgcctgtagtcccaactactgggggactcaggtgggaagatcatttgagtccaggagttcaaggctgcagtaggccatgatggtgccactgcatgccagtctgggtgacagagcaagatcctgtcccccccaaaaaaattaaaaagataaaacaacaacaacaaaaccctcttagttttgcttcttttttctattgtttttctattgttgtatttattaatctttattattttcttccttctgctaacttcgtatttagtttgttcttttgttagttccttggaatgtaaggtgaggttgtttatgtaagatttttcttattttttaatgtaggcattgattgctataacataatcatttagtattgcttttgttgcatcccaggcattttgtatattctgtttgggttttttttttttgtcttaatttatttcttaattctctttcgattttttgtttgactcaatggttgttcaaaaatatgttgtttaactttaacccatttgtgaattctctagttttccttctgcaattgatttctaatttcattccattgtggctagaaaagatacctggtatgatttcaatttggtaagacttgctttgtgatataacatgctatctatcctggagaatgtttcatgcacccttgagaagaatgtgtattctgtggttgttgggttaaaagttttgtctgtctgtcatgcccattcggtctatagtattttcaagtccagtgtttctttattgattatttgtcgggtgaatctatctattattaatagtagcttattgaagcccctggcattatattattatttttcccttcagttctgtctttgtttgttttatatatttaggtgttttaaccaacagagaaatgaaactgaaaaccacaatgagacatcatgtcacacctattagaatggatattagagtgaaaaaacaaatgctagcgattatatggagaaaagggaactcttgtacactgttggtgggaatgcaaaatggtgcacctgctatggaaaatggtatggaggttcctaaaaataatttaaaaatggaactaccaaatggcctagcaatttcacttctgggtgttgattcaaagtaattgaaatatgtatctcaaataaatattaacactcccatgttcattgtggtgctattcacaacagctaagatgtagaaacaatcccatgttcattgcggtgctattcacaacagctaagatgtagaaacaatctaaatgttcattgacagataaattgataaaggtatggtaaatatataaaatggaatattatttagccttaaagaagaataaaatcctacaatatgcaacaacatggataaaaattaggactttatgctaagtgaaatgtcagtcacaaaaggacaaatactgaaagattccagttatgtgacctatctaaaatagtcaaactcatagaagcaaggagtagaatggtgattgtaggggacagtggagaagaaaatggggacttgccaattaatttatataaaatttacattatgcaagatgcataaattttagatatctgctgtacaaacattgtgcctgcagaaaacaattttttattgtacacttcaaaatctattgagtgtagatctaagacaataaaatgatctaattgtagtatctttaataactatgtaactttgttatctaccctttcttttaaaacctaacataatttgtagagacagttatgttcctaaatattagaaccatgctaggtaaaatgttagtctactctttttgttttcagtcatggtacaagattactaaggatagaaatactcttttacattgttttaaaattcctccaagtaaatgttcaattagtacctattaaattggtaactatgcaatcaaatgtgagtgaaagtctgacttttgaggaagaaaatggcagttacataaggctgcatgaagggagtaaattgaagagttggataaccatgaaaacaggttgctgaaaactcttcttctttttatttccagcagcaaagtgaaatttccaaactgggaaataatgttaattctaaaagtaggaaagactaaatcaaattgtttgcctcccttgaacttatgcaattcaacaaaaaagagaacacaagaactacacatgaatgaccttcctactagttgaaaagaaagacctgaggtcattgtccacttggattagcttttcaggtgtttcaggaaatattttacgaattttaaatggattgaaaaacatctccattgttattttccaaggtgaacattgtatttttcacttaaatgttatataattgtgtggtttcaatttatacttgtttctgtttaaggtattgaaatgtttctaggaaaatatagaaatatatagtatgtattttttagcttagatcatcttttatattcaaattatttgctactgcatataaaaactccaaattataaatgatattaaaagaaatatcaatataaattgtttaacatatgattttaaaagaattttgttacagatatattttaaagacattgagagagaattttctacatatacagatgctccttgacttgtaatagggttacattctaataaacatcaccaattgaaaatattgtaagttgaaaatgcatttaatacacttaacctacagaacataatagcttagcctagcctaacttaaacacgctcagaacacttacatgggccaaatcatgaacaaaaatcctattttataataaagtgttgaatagctcaggcaacttattgaatactatattgaaagtaaaaaacagaatggttttatgggtactcaaagtttggtttctactgaatgcgtataacttttgcaacatcataaagttgaaaaattataaattgaatcgtaagttggaaactgtaattattatgaactatatagttaaaaactttctatgcatagacccaatggttcattaaatcaaattttagagtattacaaatcaacttaaaaagacaaaaatttaagtagaagctttttaatcaacttacgcaaaaaagtgtaatttatgaaatttttatataaattggtatttaaagcaaaaaagtcccgagaggtaaataatttcctttcatgatatttataagtttctaccttgtttttcacttaggtatgtaattgtttattacctttactgtctattcttgagaacgtatttcaaatcaatatagtctcaaaagactttcaaaatacaagagcctcaataatattgtcaaatcaaacacataatttatgtgaatgctgctcatagcaaactgactttaaaagagaccactttgtcataaaactgattttgaaatcatgaacaaagcaagaaaatacattcttaaagtaactataacggcaagatatagatatgagaccagtcaaattgtctgcgttttggtcatttgttagattctgctattaaatactttcaatctctaccaattagtaccagataatataattaattatctgagaatagctttgtaaaaagaatttgtgtgagtttttttctctcaaatctataggtatcgctggagaaatgttatcagagaatagtgccttttaaagatttgcagaaaaatgagataaatataatgcatagttttgtcaaagttgaaatgttaattattttcttagaatttcccttttaatttttatacataaagataatgccatcatattattaaaagcaacaaatgataaagcatcatgaacctattgtgctaacatttttaataatagaacattattcaatatttgcattccatagtgggaagtttaaaagagagaaagatgacataattgatttagaaattagcacttttatagaagccttcagtaagagaaatttatatttgcaatgtacttatatgttgttaaaattataattgtggatcttttgaatgtttagctgaagttatattgatgttaaagtgctataatgaggggtgaaaaaataaaaaccaatttaattagtaactaaaatatgatcctttcattttatataacaccaacactgaacattttatatcattttttccaaaattctctcatactcatacagtttaaaatagatatttatataccagatttgtattttactttatatatgcaatgagagttcttagctgccaaaacaagtgatgtcactctatttatttttaaatgaaagggattaataaaggaattttaggtacttcacagaatttataaggcctatggaaatagactgttaagtttacaaaaatgtccccccaaatcagggctagtagtccaaattgcagggcccagggcaaaattatcatgtgcagccccttgttcaaatagcatgaaaaaaatgtgctgttaaaaagataaaatacaaagttttttcattcttcagtggtctctcttctcatattgttctttacttgttacttcgtgtcactctgaataaataaaaattaaaatggaatacatgaacatacattttaacatttatctttataacatccaatagcaattttaggtgcaaatgtaagaatatttcattagtaggcagaggcattaaagttacacaatctctattttatagcttctacatgtgtattttgttcttagcagagaaatggaaatactgcacaaaacttactcaactgtttttgaaatcagcccaattttgtctcatagaactgatctttacagtttcttttgagtaaacatagaacttgaccctccagtcttaaaacttgatcatgttacatttgtcttatatgagtttctttctcaggaaaccaaccatcaggcctcccaggtagtatcaagaagtgaaactcaccagattatcacatatggataatgagacaccagatcccttacccatcatgattgcctgactgaccccttgatttgtattgactaattccccttccttacccctccctaattctggttttcccatatgtagttatatgtctttcctgctatataaacctgtcattttagttggtcagataaatggatttgaaactgatttcctgttctccttggctgtcacacttctttcctggcaatacttgctgtctcactgactggctttctgtgcagcaggcagcaggacctagagcaaactgttggctttttagtaaaatttttggttgacacacattcttccaatactctctacttttgatttattgctgagtgagggaaggacttaaggataaggaacgacaggtttcactatctttccctttccttttacgtcattattttaggtgtaaatagttgatgggtgcaggggagtaaaacaagttaaggtgatgttccctggttgctcttgtttcttaaaatcccattttcatcttttaatgtttgaagtaagttctggttcaaatgggaagtgcggcctcttgggactgttaccaacaacgcgtattcagttgtgaagctaaacacgcttaccttgtactccctttgagtctctctgaacaccaaatcatctgtgttctattagggttctgtgctaataggggcattgcaaacactctacgtgaatggggaaacaagaaacagtggtagaagtgaatattgcacatatctactctgctcgcatgcatgttccattatctcattatacttcagttatgaaatacaggttcaaagataaaaatcattaagaattcaaaatggtaagagcaggacgttaaaccaggagtggggtccttctaagcacagtgtcttgtgggactgcacatgtctaattcccatgatgttgtcctaaacaaatggaatagaactgaccttatgaagaaagggttgctcttagaattaccaaatattaagtgtcagaacctaacttagctgcgatggtactaatgataatgatggttcaccaaaaatgctttagtggtcttcccaaccaccactgactccctaaaaccaaatgacattcctaccacttatgcctgaaaaaacagattacatgtcagtttttttttctggatcaaattcttctatttctaaagctctaatacatcctaaatcactcacctgcatattagtgtcaagagagactcttaagttatttgtggaagcatgacttatgatatgcttatttcccaagataaagaaattaaattaatatttgcattgttttaaatttcagtctattatgtttacaactgctgtgaacattcacgtacaaatatttctgtagatttaaattttctttatcttagttaaatacatagaagtttcattaatgagtcatacattgagtaaactattaacatgataagaaattgccactgtctttcatagaaaccatagcattttgaattcccatcaagcaacttgtgagttttagttgcttcacatccttacattacaatgcacctagtactgccacacttaacatttccattttaatgaggcaatatcaatagaataatttcattttaaattgcacttatgaaggagtattagaatcgagcactgtttttctgtgcatatttgttatttatattagtatcctggctccaggttaaaatactatacacaattttataagctcaaccataggtaattgcaaagctttgcctatcaagccttatggggagaaagctgccctcccaaatcagacttggtgctggtgcacagtcagtatattgtagttttctagaaaaagctgcagtgaagaactcgggccactctagctggccttgcattatatgcatatctacatctctagctcagatgcctccttttgcctacatgagacctcctaattaggttggctagggcactttttgccactctgactcgcagttttccactccacacccttccagtttccttcttcctagccccctcaggtccataaaaaggcaggacactggctaggtggggtggctcacgcctgtaatcccagtactttgggagaccaatgtgggtggatcatcggaggtcaggagttcgagaacagcctggccaacttggtgaaaccccgtcttgactgaaaatacagcaattagctgggcatggtggtgcatatctgtaatcccagctactcgggaggctgaggcaggagaatcgcttgaacttgggaggcggagattgtcgtgagccgtgatcgtgccactgcactccagcctggcgacaaagcgagactccatctcaaaaaaaaaaaaaaaaaaaagcaggacacttttgttaggacttccttggcaaagggatgtttctctcccatctgtgctgtgtgtcctttgacccttgcctgataccactctgtgggaaaaaatagaacatgcagacctggaactttttctttacttctagtattcacagtcacagtaaatacagacttcattattactttcagtttgccttgttatcctaattgacaactgcaaatactaggtaagtcaacaaatatgcagtcgggcctccctatgcatgggtttcacattcctgaattcaaccagccatggatagaaaatactctgggggccgggcgcggtgcctcacccctgaattcccagcactttgggaggccgaggcgagtggatcacgaggtcaggagaacgagaccatcctggctaacaccgtgaaaccccgtctctactaaaaatacaaaaaaattagccgggcgtggtggcgggtgcctgtagtctcagctgctcaggaggctgaggcaggagaatggcgtgaaacccaggaggtgaagcttgcagtgagccgagatcgcgccactgcactccagccttggggacagagcgagattccgtctcaaaaaaaaaaaaaaaaaaaaaaaaaagaagaagaaaagaaaatactctgggaaaaaaatattgcatctataccgaacatgtacacacttttttccttgccattattccctaaacaatacggtataataactatttacatagcatttatattgcactagatattataagtaatctagagatcatttatagtatactggagatgttaacagtgtgaaagttgcagctattaggataagtcacactagtcagacccaggcaaagtggggatgggagagcatgaaggagaggagctcatgcttgcaagtctgaagataaaaactgtttcaagaacatttaaaaataaccccacaagaaataatctcacatccttcatgcataaatattttttccatggcttatgcattttacatgcatgcacatatttctatgacaaggttcattactagacattctttaggactgcagcaattcaaataagacactttcaaaagaacacttactcagtgatgatatcttcaccaatgaaatgatgccaactctggctttgagcctccagaaccaatgaactctgtttccaagcagcttacatggacctctcctttttccaaaaaaagattctctttatccttgcctctttggatgcatacgtggcttgctaatgttgtacatcctagattataattgtttctgcttgctcccaaataagatcactgtattagaatttattgctctaatcgtttctaataatttagattgacagtatggtatacacaaatatgacattattttatataagtgacttgaacatcccagattttggtatccatggcagatcctagaactaataccccacagatactgagggatatgactacagtattttgtgaagtgtcttctcaaattttcgtttctttttgagattgtctttttattaataggttgaaaatgttctttgtatgttctagatacagctcctcaatcaaatagacagatgatagatagatattatatatattttaaacatctcaaatattttacccactgtggattttgaaaggcaaaagtttttccataaagtcaaaagtatcaaagcctacttgtttataattcatgtctaattcagggttacaaagttgttcttttctaggtttcctctagaaattttatagctttagttcttatgttttggcctaaaagccacttttagtttttttttttttttttttaatggtatgaggtaaggatgcaaattcattttgttctgtatggatatttgtcccagcaccatttgtttaaaaatctatccttttccaattgatttgccttgtcacgtttttgtattgtaaatagtaatttttattttcaaacaatccactttaaaactctgccgcttacaaaatatttggaagggctagatgtacaagcttcagactgaggctccagggttaacccagaataatcaacagaaaatttagttactaggtgacattatcaggcaggtggaactttgggaggccatagctattagtgttgactgcagggattccatcacatctatgagatatagctacctccataaaatctattttgtgacattcgtgatgaatcacgaccctactatgaacactgctattattgccagaagcaacagtcaaaacaacagaaatgtggattctgacttatttctgcattccacatcatacaggagggcatctgattggtaggatctaatttacataaaaactctagcagtaatgtagtatagaaaatagaatgcttttagtctctgaagtttgggaatcaatgcaaacttaataaattgatcatatgtacagtgattaaggcatagttataaagtgcttgatatagtactatatttatttataaaaattattattctcattcatactcataccacatatccattatgttgcttgcttcactgtattttagcaaatatgtgctaccttgaaaaagaaatgtggcattatattcttttaatacatttttttaactagtgtgattatttttattcttgtgttttttcaaaatatatttctcatttgttgaaaggactatttggtctttggatttcttcacattttttgtttagtttttcgattttgtccttctcacatgaagaagtaattattactttttcagctacacatatttttggatttgtttttgccactgaattttttttcattgttcaaatcaatttttatttgtttttatcatttgttatccattcctgcacacccattatattctagagatggtaagacaatactttggagatagaagactgaacaaaaataggctcaggtgggcatagacattgctcttacaaagctgtcaacaaatgaatctaaaattgcagcttgggaaggcactatgaaggaaaaaatacatgttttatagagtgtgtaataattatgtgttgctaaagtttctatggagtttttccaagcaaataatggcttgaaataagtaagaaataaccaaagtaggcaggacacttaaatgaggttgtccaaagaaaatttaaagacactagtgtgaggtgaagctcaagacttatggagaaaaataatcatgcaaaaccttgcaggctgctgcatataataaaaatcaaatacacttttcttttttgagaatctcactctgtcaccaggctggagtgcagtggcatgatctcggctcattgcaaccccacctcctgggttaaagtgaccctaccaccacagcctcccaagtagccagaactacaggtgtccaccaccatgcctggctaatttttgtatgtttttgtagaggcgagatttcaccatgtcgaccagtatgatcttgaactctgagctcaagcaatccacccacctcagcctctcaaattgctggaattactggcatgagccaccacattcagccagaaatcagataaacttttaaagccattaagtacctaaagttttgtataattcataaagttaaatctttcaatcattcattttgtgttttattccattattttttacttagacaatctccctttccagatacttgattactattattattattttttttcagacagagtcttgctctattgcccaggctggagtgcagtggcgtgatcttggctcactacaagctccacctcctgggttcacaccattctcctgccttgatacttgattattaattattcctctgtacttctggtaagaaaatatttaccctattttgataactgaaggcttaaatcacatatgctttgtgataaaaacttgagaagaaaaattattcctgttaataagaaatagtaacacatgctgctaaatagcacacatgtttaacagtaattaactgtattaatcattagagcacacagtcttactatgatttttttttttttgagacagagtctcactctgttgcccaggctggggcacagtggcgtgatcttggctcactgcaacctctgcttcccggattctaagagattctcctgcctcagcctcctcagtagctgtgattacaggtgtgtgccatcacgcctggataattttgtatttttagtagagacagggtttcaccatgttgaccaggctgttcttgagctcctgaccttaggtgatccacctgcctcagcctctcaaagtgctgggattacaggcgtgagccaccacatccagtcttactaccattttttaaaagatatttctatgtgtcagttaaagattttgctgttcatcaagttgatcaaagcagaagcctgtaggttttccaagaacctctctataattatcatatatcccatataatagcaatcaccacatatactataatcttatctctttacataaatctcaagtctacgtgcaccattattagcatataacaagtttcttatcatctttttccaggtatgggaaatataatttcttttgtttctgtcataggtttgtagttgagacactctcctgaaaacgaaagtcagattagaagagaaaaccagcagaagtttattgacatgtgctgtaacccatcacttgggagaggccagagtctctatctcccagtgcagtggcttaggggccttgcttaaatagtatttttaaaacagccataaatcttatagcaacaaagcagagaagagagtagtttcaggtttccaaaaggtgggaaactatgggaaggtaaatttatgggaagagtgaagtctgctcctagatcctctggcaaccctgtctctgagctgataagcaagccttgtaaaaataagaaaataataataataaaagactgtctttaggcttgaaaaggcagacaggagagcaggaagacttttggtctttgtaaattgctgccttgccatcaggcaagtacaggcccagcgatccccgcatcttttcttaaccttctgcagctcagcaattttcagtatttccagagggatatttcggtttccttcacaggagtattataaatgggtgctattgagcctttcttcctctagatttacaatcatcaaatctattctgaatcctgacacaagacagatttcttcaaagtgcaattcaatattatcgttttcctgtgcattttcataatcatacttttttaatttaattaacattttccatactgttctgtaaactctgtgggcacaggggcaatttccattttgtgtatcagtgtactcagtgcctagaatatgtagctatgtgataaataattatggaatgaataaagaagtatttcaaaaacttcactggctttccacgacctccagaataaaggcaagttcccataaaacggtataaacatccatgatcagactcctgtgtcttccgtctgatctattgccatttggttcagtaattcagtgcttcatacactgtgaagctcaaggacacctcctccctttgctcatgatctcctttttgcctgtagcaaaatctccacttaacagtttacagcctcaaacatggccattgctaaatcaagtttagtctaaagctgcctccttatgtattttaagtttagcctaaaggtttctttgtacatcatgaacttaatctaaatggaattgtaaacagactgtaggctactcttgtggcaatcactgagtttgggccaatcaaatgttgccaactgttcaaactgtgttcaaataaggaaggcaacgtggagctataaccaatccagctgtttatgtacctcacttccgttttctgtaggtcccgttcatttttctctccataaatcctctcagccacgtggctgtgctggagtctgaatctactctgtcttgagagactgcccaatttgtgagtccttctttgttcaatgaaactcttttaaatttaattcagctgaatcttctcttttaacaccatctaggaagacttcttaaaatttcctattattggagtagtgagttcttcacttgtgctccaatttgcatgcatgtaaccagcatgtatctttcgtgtcctttgtaggttttattgaaatagccattttatatctgccagtcatacttaactgtaagcttctatgaagcagaatgacattttatttgtgttttgtgcccttagcatctatcaaaatgtctagcacaaaacaggtatttgaaaaatcttaagtaaagagaaccaaagaattgttacatatagaaaatgactagaaaaataaataaaacaagagagaaataatgaatatctcaagaagttatctttttaattatctttttattatagacttatttagaatataattgtgaatatacattcttagcatgtgattgtgatttaaaataggcaccttgggatgcaaagtcttcaacgggacacagttagaaaacaaaataataaatgtcctcctttatgtgaaatgatcaattctaattttatgcattgctgttctctttaaattctctttacccttctgagataatctttcttttctaaaagtgtcaaaaaatgatttcagaatcagctttcctgtttgcttccagaagttctattgcatttggcaatacaagagaaattaatgtgagaatatgtaaagaaataaatttctaaaatctggctaagcaaaaaaattggtgaattcataaatctgtgttattggatagtatctgcagtaaggcaaggaggaattattagatttctttggcttttatttttagtgttatgactatgtaatttaatgacttccacaaaagttatttctattttcttgcttaatttagttatttacaaaaaggctttttatcatctaaatttattcaattaaatggctcttttataagaaaaattgttgcagcgaagttttttgtgacttcctttgcaaagaatctctaaaaacaatgacgcaatcatacaatttaatttttattttagtgaaacttattctttctaaactttggcttgacaaagcttcatttatgtactggtaggatattgttaaaataactacaattaaaatgtttttattatgatctttcaacttatctttagaatttgattacttcagtaatatattaatttatagttatataataatcatcataataaatgcaatattttcttaattatttgtgcttgtttatccccatttcctactctattcctactgtgttcagaaattacatctttgttgtatttcactcttatttgaaatgtaaatttattcagggagagcagcaggtgagtgacaaagcaataaaaagttgtcgcaacagagaatttttagatcattttatatttttatatatatggaaaaacaatatttaatgagaaaatgagaatgtttttaactttatttcctcactgtctttgcaattaataattctctaaatacatggtctgttttcccctcaagcctcagtagctggctataacttttcaatggttaaactgaaggactttttttttgagacagggtctggctctgtcactgaggctggagtgcagtggcactatcatggttcactgccacctcaattccccctcaagccatcctcctgcctccagcctccgagtagctatgactacaggtgtatgccaccaagcttggctattttttttttttttttactttctgtatacgtggctgctatgttgcccaggccagtcttgaacccctgggctgaagcactcctcccgccttggcctcctaaagtgctgacattatagatgtgagtcactgtacgtggcctgaaagacttaaatgcataataaatagattatgaaaaacaaaatgcagtactggcaagtcccaaagtggggctcagcccaagagggtcttggctttgcccaggaaataattcaagggcaagctggtggtagaagaaaacagcttttcttttgagacagtctcattctgtcacccaggctggagtgcagtggtgtgatctcggctcactgcaacctccatcttccaggctcaagcaattctcctgcctcagcctcccaagtagctgggattacaggcgcacaccaccacgcatggctatttttttgtatttttagtagagacagggtttcaccatgttggccaggctggttttgaactcctgacctcaagtgatctgcccgcctcagcctcccaaagtgctgttattacaggtgtgagccacagcgcccggccaaaaacagctttactgaagaggtattacagctccagcagtgttacagcgatgtgactgcattctgctctgcagaacagggctaccccataggcaatatgctgacagtagcagctcagtgcagttttgcagtcatatttattcctacttttatttacatgtagattaagggattgttaatgcagaaatttctagggaagaggaagtaacatctggatcatcaggtcattgccatggaaaggggcaggtatgcctcaatgttgccatggcaatggtaaagtgacatggcacagtggtgggtgcgtcttataaaaaggtacttctgcccatcagtcctcattttggtttggtgtctgagccccacctccagagtccagccttgcttgctacttcagaagtagagaaatgatgaatacagaagcaacataaggaggactgtgtgaaattgatgaaagagtaaaggaagaaaaagaggtcaaaagggaacaaggcagggtgaaaaattacgatagcacaaaaaatacacagactctgctggggagaaaagaaaaattctcccgtacccacttaggtttccaggctgggcctcagagttagaccaacataagacagcttaacaggagaaaatcatgcaagtttcagtaaaatttttacaagtatatgggaaccttcatgggagaatgaagacccagagaaatggccacagcagaaagcttttatacttttttgacaacaaaataatacatttgtgaggaaatgacaagacaaaggggtttgggctagaggcaataaattgtggcgaagtgaataggagataattgtggtgggcaggggggtggagaaaactagtggaagatgaggatcattttagaacattcattcatacagatctatttttttttattatactgtaagttttagggtacatgtgcacattgtgcaggttagttacatatgtatacatgtgccatgctggtgcgctgcacccactaactcgtcatctagcattaggtatatctcccaatgctatccctccctcctccccccaccccaccacagtccccagagtgtgatgttccccttcctgtgtccatgtgatctcattgttcagttcccacctatgagtgagaatatgtggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggtttcaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgtttcttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgccttttcactctgatggtagtttgttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatacggaatcctttccccattgcttgtttttctcaggtttgtcaaagatccgatagttgtagaaatgcggcgttatttctgagggctctgttctgttccattgatctatatctctgttttggtaccagtaccatgctgttttggttactgtagccttgtagtatagtttgaagtcaggtagtgggattcctccagctttgttcttttggcttaggattgacttggcaatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctctttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttttcatagatagctcttattattttgaaatacgtcccatcaatacctaatttattgagagtttttagcatgaagcgttgttgaattttgtcaaaagctagcagaaggcaagaaataactaaaatcagagcagaactgaaggaaatagagacacaaaaaaccctttaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacattctcccaagactaaaccaggaagaagttgaatctctgaatagaccaataacaggatctgaaactgtggcaataatcaatagcttaccaaccaaaaagagtccaggaccagatggattcacagccgaattctaccagaggtacaaggaggaactggtaccattcctcctgaaactattccaatcaatagaaaaagagagaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacagatctattttaatgtcaattcccagtctctggtgataaggttctcttcctggtacagggagagcacctttctcatgggaatttttatggcctcttttgagtaaaaaatagtaggtcagaaagcccttcctgcatctgctgtttcttaagtgccttcaacacaaaatgataaatttggcaaagcagcatattttggcatagtgtatccttaactccttcagctccaaaataacatatatctgtgacatgtgcagagcctgaagcacaaaatagtttcgaattttggattatgaaagttaaaagaatgagttactgctttcatttgaattacatgatttatcttaatgaatagtagagcatcaggatgattgaaaatatgataatcaatattgtgaggaattaatattacaaaattatatttacttgagttctttagagcagatttttattagaaaagtaaatgggaacacattttacaaagtaaaaattggaattaggtttgatgtaaacttgtaagtaataataaataaatctctctgtagcattctgaatgtgccattataaacatttcatcctttcattaggaaaataggaggaaactcccaaatatttgggacaactcttctttttatgcagaaatataaaaaacataatctcagcaattcagaaagttatttctaaaaggattatatatatatatataatgtacacgcatctgtaaacatatatagatagataaatagatacacatatatagatatataaatgttatttgttgttgatgagtttgaatttttttttcttcttggaaaaactagagagtactacagatctccatattcagggtttttttaatcagaattttttgctttttattatcattggagactattactgtaaatttttaacatgttaagaatactgtgactattaactattccaacattaatattatataagtgaggaaattgaagtccagagataaaaaaatagttgctcatagtgataaccagttatggcaagttatggctgataattgattacccaattcacataaagaaagatgtcttgcaggtactgtgatcagtggagagaaagtcaaactaaataataactcgcatacagtaacataattgtaatactaaaaactatgtgaagatgccttgggaacataatggggttgagaattgaaaaagatcttccttttgatggaaagcaagatttgagtagtgtattgaagtatgtggaagcattaaaccagatgaagaagtacccggataggaaaaggaattagaggcattccataccaacaaaatagcatcaactaccattatagatgtgagaaggatcataggaaatggtgaatatgtattgtcatgtgtggaatggcaaacaagctatgaggcagggcggtagttcactttatcaaaatatgccaatgactaccacatatcaaacactgtgttaaaaacagataacataaatattaacaagtcatcattctacctgtaaaggagaagctagaataaaacatttgcatgtatatgatcaagatagatagactgataacaataaagaacgaattacagttttctacttgtgctataaacaggatcaacatgataagatcatgtttacatggcttcattttgattttcttgctatctagttgttgatctctgtcatatgcaacatttttttctcaaaacgtgctggtgtgaaatctactttcatatataattaaagcattattttcctgaatgttttctatttatttttaaaacttggtagcacgtaacactattattataccttacttcataaaagttgaattatggaggccaaagaagatcaataactttcttcagaacctttagcaccaccataccctaaaaattcaggtgtcctagtttttgtttaataccatgtcacatattcaattccaagaacaaattctcttaatgggagcctgatgtattaaggaacaatgttatctctactgccattcacaaagatgataatcttattactttgaccttaaaacagtagaagttaaatggacagctttgcttacatgaaaataactgtttcaatacccccaaaagaagaaaaaggagggaaaaatcccacaaagtacttattagatatacaatatggtgacataatagcctatacatcttttaatattagtccatgagatctgtgagggcagacagtgtttatcttgttaaatgttttaaacccagtttaaaacatacataactcttgcaggtaaacatggtgcatagcaactgttgttatgctaaattttgaattctatcccaatattctatgtttactcactattgattgaataaatgaataaaaatgggtcaaggttatgcttgtccaaaacattcctctgtctaccattgtgtccagaacctacctcagattacttctttcaaatcctacattttcttttaggcatataggattaagaacaacataaaaatactgtctctgtgcaaagtacatctgttcaaaaatcaccaaatcctttttgaaaggaattaaacactaatagttgcttacgggcagcaaatgtagccaaatgaaaagcagaatgtgggcgatgctaaggtcatttgtaatgatcccaaaatcaaacttcccacatcatcattttaatgttactgtaaatgtagctctgactattagcaaattgactaaacctgctcatttctaatgtctcaatgagtttgtaatgatttaatctgtgctaaaaaaggaaaaataaattactgtgagattttagacaagagaaaattaaaaattgccttatgtccaaagttttaatttgcattttgtcttaataatcaattaatttctcctactctgtggtagctttctgtgtatctcatttcctacaagcagataagaaaattttgtaaaacctatttttaaaatacatattttataaaagtaacaaagacaagtaaaaatccctgcatttagtttaaataggtagaatgattatcattgtttaaccttttgttcatgtaaaaatatatgatatgtgtcgaaagaaacacatatacctagatgcacacagagaaacacatataaaactgattaacagatgagactcaattctttttgtggttatcatgatatgttgtgcataaggatgcttatttagaggaaaatatgtttaaatattaagactacagacttgtttctactaagcagagattgcttcgtatgactttctttggtctcaagataacacatgtatactctattaacttatttaatgatttacttatatttcataatattaatgaaataataatgaggaaaacatgtaatgtgctatttttttgtgataggcagaataatgatctctactgatgcccatatcccaattttaaaacttgcgagtatgttagtttatgtggcaaagggactttgcagatgtgattaaggctgaggaccttaaaattatcctgtgttttccatggctctagtctacttacatattactgaaattagaagacctttccaggatgttatcaggggatttgaagatcctatgctactagttatgaaggtagagaaagaggacatgagctaagacatgcaggaggcctctagaatttagataagtaaagaaaagagaatctgtttctcttttagggcctccagaaacaaatgcagccctgctgacaccttgatttcatgccagtaagacccaaaataatcatttcagacttttgacctactggggtataatgtaataaatttgtgttgttttaccaaactaagtttgtggtcatttgctatggcagtgatagaaagtgaatacacccaatttcataacatttgtaaaagtttttattaaaacacacacagtcagtgaataattaagcaatgataatgaaaagacgtgttttttggaggaaaaatatctctggatttagaaagcttggggttttatcctagccatgctgcttactctataagtggcctaggattaaggactcctgggaagctcagttcttcatacatgatatgggaatacaactaactttcttacagaattatttaatacatggaaaatacaagatttataatcaaaagcagaaatctcataatcttaaagatttgtaccatagctttgagattcaaatataaagacagtaaaatatttttgactaagtattttattaaactaaattaagaaatgtcctatctggaacacagatctgtaaaagcagcatgtttgccagaatgtttgtaggcagatagatgaaggttagtaatacttagatcaggctgagcacaatagctcacacctgtaatcccagtgagagaggaggcagttagaggctgtttaggcagatggagagagagggtctcgggagtggaaaaatacccatgggatagcaactgctgtccctgcaccacccctagagctagcagaaagaaatgtggttaagaactcacccttatgttaaaaggttgctcagaagggactgttccaacttaggtgcaggcacaatacatcaatatgatattagcactgtggttttagcccctccataggtttcacttaggcactcatggataattaccaagatggagtcactctggccaaacccaggcatgcacagatgcaacatgaggcactaataagagagaaatttactcctcccatttgggcagaacccacagactttcttgtctttgccacctaaaagacccagtactcagtcccatttctgacaacctgcgtttaggtctcctctcattgctgagaactttccttttgcttaataaatcctactctactcactctctggtgtcctcatgccttattcttcttggtcatgggacaagaactcagacctagctgaactgtggcctaagcaggctgcaacattttgggagcttatccaggatcatcagaagggtgagtaggagcagacctctcactcattattttcatttctgaggctacttgtcctcagtaattttctcaagatcaaataaaacactgggcttctgttggccagctaagagtgactagtgtggcttccagacttaagactcagaggactggcttgctagggaagactttgtcaatcccccattgcccttgggtgttgggaatgttgactctgtgccaatctggtttcttttcatggaagtctaggtgccgtgtaggattggaaggtggtcctgaagcaactgagggtatctgcttgacgctacacttcggttacccaaagacccctggactaacttcagtccctgacagcctgttagggtgttagcaagagaacttctggtcttttcctattgcatttttcttctttcttttgcagctgtatggctcctatctattctaggtatacaatgttgtgggtgtttttgcaacccagagatacaattttcttggataaaataagcaagtgccttagcaatcaggaatgcaactcaaagggtttttgttttgtgatttcctagagaaaagaggatttcaagatctagacctgaatgtctccttatcccctaatgacagcacccaatggcattgcactggaggttatttctccctgagtgactatcctcctctccatttaaactgtttctttttctatgtaagaactcagcactttgcagtgaatttgtacaaccctccaatgaggcaagttaattttctcctcctgggagtcttgctgtgggagcagcctgtcaagccccagacttctcttgcaaacttttgcctgaaaagtatctgggcagagttacagattaacattccaaactctgtcaagccactcaataaaattggaatttttccatagggggccttatcaaccctctacccaggggctttagttctctggccacttattctcctgaggcagcctaataaggaccaaatcgcctgccccatctgtaaataagaaaattgagtgtatgatgaggaagccacaaaaaaaaaaaaaaaaaccctacccagatggctgttaactctcatgtgatcaccactgcggggaaggggtcaatcataccctcacatttttcaaagacacttattctgcatccagttagggtaatatttagatagaaagatggaaatatgtttggaagttaaccattctcattttcttgggtgccatggtttgactcaagacattatctgcctatgaaggagtgagttaatgcagggatctgtcccacagaccctgacccaacgatggatgaataatgtacactgacacagatattttgtcttttggtttggctgagggtctgggccactcacagacaccaagaagggtgctgtaaggagtcgcagctgtgaccccaatcagccagcgaagctcgcatttattcagtatagattaaataacaaaggtcttgagtaaacaccaccagagggtaattgacattgccgacctcccgagtagagagcaattatatacccgcaggtaatcaaaggttggtcttaggaccgcatgagtaaacaagctatttagataaactcccttacatccctttatacctaatttatctactcaaggtaaagatcaggctgcattcagccagatctattactggagcttatgcaaaccccctggccttccaagaaggtttgtgcctatttcatataactatctttaaaatttttcccaccagcctgactgaactcccacatcagttaagagattgactgaggaaccccccaccattaaaagttctcacccaagttcagttgcttcaaagcatcttccaagctccagtttggaaacccaaaaggacaattagatctgggagacgcagaggcagtcagcaggagaggactagagtacagcacaagtgagcatgattactcctgccaactagctcctctggattcatgggtgaagaaatcagataaaaattactcagcctttttgaaaagactgaaagaagccttggtaaaacacactgccctggctcttgattcaattgaaggatgactaattttgaaagacaagtttattactcaggcagcccctgatatgtggaggaagttgcaaaaacaggccacaggaccagatagcactttggaaaacctgaaggtggccacctcagccttttacaatagcaatcaggaggaggctcaggagaaagagaggaagcacaagaaaaaggcagaggctgtagtggccactctgcaggcctatgaaacccaggattcctgaggtgcacctgctaattgccacaactatggcaaaccagggcacattaagaaggatttcccaggaagcaaaaggaagctaccttgaccctgtccaacctgtgttgcggacaactgacatgtagactgtccctggaggcacagtcaccaggtccacagccagcgtcacaaatgctcaagcaggactgatgtgtcatggggctccttttcctggctccaaaggctcagactgccattataatccaagagccctgggtgattctagaggttgaaaggaggaaggtgggaaagtctgaagtgaaaagtcaattttctttggcaaatacatcatttgacttccaaattattgcattttagataagtgtttcttaaaaagttacggattgtgggggttcatcctgcagaccctgacccaatgatggatgaataacgtacactgacacagatattctgcttgtcagtgcagctgagtgttcggacctctcacagacaccaaggaaggtgctgtaaagagtcagcagccatggcctagatttgttggccctcctggcatttattcagcatgcattaaatgacaaaagtctcaagaaaacacgattagaaggtaattaccattgctggccaccccccccccccaccgagtagagagtaatcatgcacctgaagatggtcaaaggttagtcttagtatcacatgagtaaacaagctatttagatagactcctctacattcttaagttaattacccttggtatagctcaaagaggattaggctgccttcagccataactcaatcctgaggcttttgcaaaaaccttctggccttccaagaaagtttgtatttattttacagtttttcccaccatcctgactgaacccctacaatagacagactccttggaaaatatttactgaataaagttattttaactcattttgtttatatctttacatattatagaaagacagtagtttaataataaattgtaaatcagtctaagaaactaatacaagtaaaattaactacacttttttaatgttaccactgaggttgcttgcctgactgatgagtacattaaatacgaatttgataggaacaaatgtgataccaaatgttttgaattaaaagtatgtaacttatgagatccttatggtaactcaatactaaatcatttttctctactacaattaacgtgaaaattccttttgcagcataagcacttacacatttagttttcactttgaacaaatgttaaatttatataatttaattttgctctgcccttttcttcataggctcacataataaacatgatacaatctgcaattattaatagaggtaaaaatacaggcattgaaattatggagtcataatcaattttaaataaatcacacaattataatatactatatattttgattaattaataaaacagaatttgaaaaataaataattcggtgaacacatatcatcaagtatttggtgaattgtgaacccatggtttttgtaatattatctggaatcattgagaagctcttacatgtttaatctttcaaagaccaagttattcaatattcatgtaaattcaagtatttggcagacagtgttttgggtattgggattatatttgtgaacaagaaacaaatgtgctcttctttcataatgcttgtaatacagtatagtattagatcatattatgatatgatcagttaatatgattagtattaatcatattagatgattaaacaattacatacttttagagttacacagttgaaaatggaagaaggtaaaatatcattaagtgtgtgggttttagagacaacagcattgattcaagtctcttcttaacttttaataacaatggatttgatatctttaaaaatttaatttcatatttgcaattgtacaaaataaaagttcctacttactggaactattttgaagattgattaagctaatttatattagctccttagcatataataaatattaaaagtactagctctttttgaggggaacaaaattcggattttaaagagggaaaattctgcaaagaatttcttgaaatttttccagaaaatttactttaaaaaaataaatttcattgtatagatttgaaattttaccacacggtgttatgggatacgtatagatattaaaatggttactatagtgaagcagatcatctcactcacatatttcctttctgtgacaagagtagctcaagtctacttatttaacaaaaatccctaatacagaccaatgttattaactatagtccgcatgttgtacatgagatatatagacttgttcatcctacattttccacttttatcctttgtcttacatcttcccattttcttctccacctctagcccatagtaagcatggttttatttttcatctttgtttaatttactttgttttggattccacaaataagtgagaaaatgcaatatttttctttctgtggtttgtttcacttagtgtaatgtcctacaggttcatctatgttgtggcaaatggcaggattttattcttttaatgactgaataatattccgtcatatatctctatgtatctatatctcacagtttctttattcatttgtctgtccatagacacttaggttgtttccatgtttggctattgtgaataatgctgcaatgaaaatatttttagaaggtggtggtgatttcacttcctttgggtatatacctagaagaggaattgctgggatgtgtggtaattctatttttaatttgttaaggaactgacatactgttttatattatagatgtacctatctgcattcccaccaacagtgtgctaaggttctcttttctccataacctcaccaatatttatctcttatctgttagataaaagtcataataagtgtgaaatgatgtcttatagtagttttaatttgtattttcctgccgattaatgatgttgagaaccttttcatatattatctggcaattattatatttttcattgaagaagtgtccattcagatcctttgctcattttttaatcatgttgttttctgctattgagtggtatgagttctttataacttttaggtattaaccctatatcagatatgtagtttataatttttccagtctatagtttgccctatcatttgttgatcatttccttcgctgtccagaagtttttaagtctcatgtggaatcatttatttatttttgcttttgtagcctagggttttgctgtgaaattaaaaaagaaaaatctttgccaaggccaatgtgaaggagctttccccctgtgttctctcccaggaattttatggtttaaagtcttacatcttttatctattttgagtttatttttgtgtattgtataagataagggtcagtttaatttttttgcatgtggaaatccagttttcccagcaccatttattgaagtgtctctccccatgtgtcttcttgatgacctggtggaagattagctgataatatatgcttggatttatttctgcaatctctattttgttccattggtttgtgtttttgtttttaagccagtatgatagtattttgattactgaaaccttgcatataattttaaatcgggaattgtgatgcctccagctttctttttctttctcagtattgctattgctattcaggatttttagtggttccgtacaaatttctgcattgtttttcctacttctgtgaagaataccattggaattttgatagggattgcaataaatctacatattactttgcttagtatggacattttaacaatatttattttaccggtctacgaacaaggaatatcattcaatttttgtgtcttcttcaattcctttcatcattgctttatagtttccagtgtacaaatctttcacctccttggttaaattcattcctactttactttttgatactatcactaatgggatcattcccttaattgctttttcagacttgttgttatttttgtataaaaatactatagatttgcgtatgttgattttgtattctgcaactttactgaagccatttattagtgctaaatatttttaatagaatctttgaggttttctacatttaggagtatgctatctgtaataaagataattttacttcttcctttccaatttggatgctttttattttattttacttatttttttgttttatgattgctcttgctagtaccttcagtactatgttgaatataaatagcgagagtgggcatccttgccttgtaccagaccttagtaggaaagttttagttgtttctcatcaattataatgttagctgtatcattttcataaatggctctaattatgttgagaaattttccttccatacttaaaccactaaaagtattttttaacaagaaagtatgccgaaccttgtcaaatgtttcttctgcatcaactgagataatcatatggttttcatctctcattctattaacgtgatatatcactttaattgatttgcatatgtgaaaacagacttgcatgccagggatcaatcccactagatcatgatgtataatcttcttgatatgttgttgaattcagtttgcaaatattttattgaagaattttgcattaatgtttatcagccatattgacccatagttttctttcctttttttaaaaaaaaatccttttttttttttgaagatggattctcgatttgtcacctgggctggagtgcagtggcgcaatcttgactcactgcaacctccacctctcaggttcaagcgattctcccgcctcagcctcccaagtagctcagactacaggcatgagccaccattcatggctaatttttttgtatttttagtagagatagggtttcaccattgttttcttaatattactattgggaaatgacaagttggccaaagtctcatggatgctagcagaagataacactattgagaaactaatttctgattccaaaaatctatgtttttgctatatcacctgccctattattatgctttgttagccaatcactgctactatagcagtttgcttcaacccaagggagggactaacttatgtttggctgtcatgagcattaagttcttctgagacctcaaaaaccctatagtgacacaagtaaaagagaccaccactgttggttagccatgaagaatacagggttctgagaccaggggagagctaattattgtcaatctgaatattgtctggaacagcatattgagagcacttccaagaattaagtcaagattgttcagtggcctctgtcaaggacacttcaaaaagggtataaatgtgtatgtcccacatttgcctttactgtttcatttgagtatataaaaaagctgatgaccacacacatatttttaaaacatggtcttctttcctttgggaaatattttaaaaccaaatactcttcatcttttcaaatgcaaatatagcttcccaggacttttacataacataaaacactcataaaaatattttacacacataaaaacattttatgagtatttgcgaggagttcccttaaactcaagacatataaaaatgattcctctttactttgataaaggatctttgatttattcaaaagtccaccaagtataggaagacatgtaagcaaatcacatttatagttagaatgacatgttgaaacgcagctgtgaactagtagatcaggtaagcctactgtttaggatgttcagggtataataagtttttatatatttttgttacttgaaagtcaaaatactgaagattatacaggcaaatgttgtacttatctggtttttattttgatgcttacttatttttttaatttaataaagtatattattttatccaggaaggaaatgccaagtttttcttcacaggaaagtttatagaaaaatatttgcaaatatatctttaaatatgtgtatatctctaaatatacacatcaataacaaccaaaaatatatatatctcattcaagatggttcactgatcccaataatgcttaaatttatacttaaacttaaatgtttgcatttgtatttcctaaacctgcttagcactatatgttagataaccaattgctattcgcagtgttcatataatatgttatatctattcagattatacccttgtatatgtgcaaaattatttttaaaggacatatataaaatctgaaaaaccatttattaatttaaacattttttaaactttctattatttttcttataaaagtgtcataagaatatctggcatcctcttggtaagagaatagatatagttaatgaaagcacagtgctgagactatttttcagctttatggaaatataattgacataaattttgtatacttcaagtgtaccatatgatgatttgattgcatatgcaatgtaaaatgattatcaagatcaagtgagttaacatacccacatcactttccattgttacaattttttggacatgtgatgagatctactcttagcaaatttcaagtatgcaagagtattactcactataatctgagattttatttaaattgataattatctgaagcatgagaataaattcacaattctatattcaaaacttgaacatacgttaaataaatatgtagctacaaacaatgtttgaaagaacatggagatattcaacatcgaaaggttaccgtgatttcatctgagtaaaccatttaatagggaaaaaaaccttaagtttcatttctcaggtttttagaggttagaggacattttgctgtactctaaagagggaaagttatgaaaggagcatttttatccattttgtcaaccttttacttactcatgtgcaaaggagaagaaagaaattactgaactgataaaaccggaaaagggatttaactgtatttgactaaggacttttctcttttttgtctccttctacttttcttcattaagacacatggatcaggtccccaacctaacttctggaggaattctgagtgcctaggtaactatctacatagaccaacaccctatattaagaaaaatccatgacaaaagttatgcagaatataaactagaaaaagcaactggaaaccagacctacctaagttttacatactataaaactgtagatagtattcccaagtctatcgaaattctcctcagtgatgaataaaatcacaaaaattgctgtgcagagagatatgataatggctaggaaggatatgagggtgaggagaaccaatatttattaagcatccactgtgcttcaggaaaaacatcacgtacacttttcccacttctaaatcctcagatcctagaattttgtctggaatatattaggaactcaattattgtcaaatgagtgaatgaaaaataataaatatattgctttcttccagaattattgcaataatttcttattaattccctccttgcattctgcacatgtctaccagaatgttgcagtaaagagctggggctaagaatggaaattattttgaaataaatacaattctaagggttatgaaataaagaatatggatgttccaaatccctgtagttacagcctgtcacaaagagttacaaatgggttttcaaatattaagcctaattcgctcacttagttttaattatgtgagggtttacagagtaagaatgcagttgtctagcttttcaagggaactaaaaacagaaaaaaaaaagaatggcatgcactaaactgtgattcattgcatatataatcgtctgaaactgcaacttagaaagttacacagttttaacgtgtaagtaatgcagagattaatgatataacattattgctttgacagctaaacagataactctagataaatttccactgacatatctgaatactgtataaataaactgaatgacctttatatatgtagttgactgtagagaagggagctagcttaatatatgtaacaccaagagtactagatagctgaagcttaatatcaaaaagaaaatcaatatacattatgaaatatttaaaacataacatttttagcattacaaaaacaacataatacaggctataccctgcaatgttacataactcagactagagcagtacttaatataagaaaatctaggacaagtaaaaatagatacctatgttctaatagaatattgaagtatatactaagggtagatattcaaagagttgtaaaaaattctgctttaataagtaatcacatttttgtgtttaaagtttaaactgtgcttctggaacactgaaatgctccagttctaatatcattgagcaacaattcaatataatgaattccagctttttaaacaacatttccaattttaattgagttttgataaatagcaataattgcatgaggcttagtaagaaaagttaccataaaataatcttttaaggctttgtttaaataaatagttcatgggcattatttcctagattaattcaacttgaattagtctattaggagatcacattgaggtttagatatattgatttttgccattttatgttgtaaaatttaataggtcaaagaaatgatttctgggaagacataatcataaattggtgagattcacaaaataaggttattatccccagtgaaatatgacttgagataaaaaatataaaaattattttagttacaacaagtagattatagatgcatgtgtatatgtgggtgtatatatatatgtatatacacacacacacacatacatatacacatacatgcatataatgtatatttatccagcatatacctaaagaggagatcagggatcgtatcttgaaattttagaaaatattgccgttttctgaaggcttttctgagcagtgatttttaaagggcctatggttcaccctgtctttggtagaaatgtaaacgtaaaatcttatttataatttagtagcaacaattactcacaggtttaattatataactaaagtgccagagtttatttgaagattgttactttttgaaactgatgtatttataggaaagcaactgaaattagaacagatggagttataattttaaaatagcataaagaattactgaaaataatttacagtattattctatctcttgttggatccattctaaatatcttttcttttgaagctttctacaatattttattttatttcacaacctcttcataaactttacaaccttgacaattttttaaaaatctttttcatactaatgcccatattattatactctcaaatttaataatttaataagctagtcatttaataatctagtcattaccaagtaacaaattcaaaatagttctctattacttatataatcttgacattaagaaattgaaagagggatgcatctcagaatgcctataagaacatattagtttattttaaaacaaaaaaatgaatattcaaaatttgcaaaagaagtaaatagactcaacaactggtttgtttttatcctggaaaaatgtattttaagacttggttccaagcattcaagtctcagtcaacttaaacacgataaactttaacttttaaataagataaactggaatgatatgttttcacatcattgtgaatctcttctgaatgtactagatttatatttctgaataataaaaaaagacacacaacccgtaggattgtgtgaatgtctctaaatattatgaacattttcaacatgaacatgaacagaattattgtttcatttagtagcgagatgaatgacaagcgctaccatttaagagcatttactatatgcctgctctttgtgaatctgtttacataaactgtctcatttaatcttcacaatggcccatgggaaagcagttatctcccttctattgcaagtaagaaaacaagtttaaggaggttaaatttcatccttacagtcatgcagttactagataggtagcgcggaaatttaaatccagttcttattccaaagcctaaacttttacccaggctggagttcaatagtgctatcttggctcactgcaacctctgccccccaggttgaaagaagtcttggcgcctcagcctcccgagtagctggtatcacatgccaccactccaggctaatttttgtatctttagtagagatggggttttgccatgttggccaggctggtctcgatctcctgggctcaagcaatcggcctacctcagccttccaaagtgctgggattaccggagtgagccactgctctaggcccaattactactttacgtaaaggactgaaatattggcctaaaaatgccgggctaaaaacaaacaaacaaaaaaacagaaaagcaaatctgtgggaacttaagcagaaaataataagagcaaatattaacagaatggatgtcaaataaatagaaccaagattatgaaaatatgttccttacaaaagcataattaataggcaaatctccggaaacataaacgaaaagagataaaagacgtagtaaaagatttgttaagaaaaattgtgatactgccataaatacagcagagaagagattttaaacactataaatagaggctgtggaaaaaatttccaagaaatttagatacaatgtgtcattttgagtaaatatatgtaaaaataacactgtaaagttaaaaataaaattgacaaagttgagttaatatcaaaattactgtttgccctaccttttgccaaaatagatagtagtcccaaaagataaactgttgagtgctgaactttatgaaacatatctctattattaacaagcaggaagcattttattgaacaaaaataaaggaaatggtacttaactagtattataggtctagtaaaaactggccaagaacaattcaagaaaaaattaaactgacttcacttacagagattgatgcaaattcatcacaaataaatatatcaaattcagtataggggaaacagcattttcataaagtggttcatctttaaaaagcaaggatatcttaatatcaaaaaaattattaataaaatatatcttaccagattgaagaaggtaaaacacatgttcacttcagtagatgcagagaaagaattttataacatttaagctctattctcaacaaaaacaatttcttagccagttagcaataaaaggaaatgttcttaactcaataatggatatcttcgggtggcttatgatttaatattatttaaaatatgagtttttagaagtattcacattgaaatcctgagtaagtcaaaaattatctctgtcaccatttatattaaacttcttatttgaaggaacagatgaaatagattgagaagaagcaaaaactggaaataaggagcaaatataaaaactgccatgaagtgcagcttatatgaatttctacattaaaagaccagacacattctaaaagctaagttggaggtttaaagaatagaaaatatttttaaaaataaaaaagggtttattataaatcagtattaatgacaatcataaattggcttgttatttacattaaaaaccaatgaagagagaaactggaatcttgtacagaaacattgggagaatggtaaatggttataaccaccctataaaaatatttgacagtgtatctcacaagttggacctagtaatcctggatatatccccattgaaaatgtggattcacaaaaaaagacatgcacatgactgttcatgtcagtactatccattaaagccaaaaacagtaaacaactcaaatataagatatttaatacatgatggtgggatacttaaacgttcatctaaaagaaaaatagaaaagaaaatgaaagaaaaataggtaagaaaatgaaagaaaaatagaattgtccctaagactgtacataaaatcaattcctggcaaattaaaggtttaaatttcaaattaaaaaaagaaagaattaaaaatcttgttcaaaataaaaagagtgaatatctgattgattaaagaatgaaagcatttctttaaaaagatattgcctatgaaggtaaagatgtataaattagactatgttaaattagctctgtgtgttcaagtagacacaccataaaatttaaagttagtctcagactaggataaagtatttgcagagattaaattaatattattgagactatgaaaagcattcctgtttatgaataagaaagatatacaatctattagaacattatctgtaagtttggggaacaaatgtggagaaaggaaatttacatatgctattgctaaaagtttgatttggcacaactattttgtattgttattttaacaatagctatcaaaattaatagctgagatttactatcacctggctattctaattctgtatatactagataaacccctgtgcatatgttaggcaaatttggaagaaaatatacaaatttgtgatagtcatataatttactactaaacagcaaattgagtaaataaatcagaggtgtatgtagcaatgaggctaaatgaaatgacgttgtgtgaaaaatcaagttgccaataatttgtatgatattttgatatttatataaaatttgaaaatatgcaaccaaggcaatatttttcttcttggtatacacccatatatcaaagaagaacaacatgaaattattaatattagttacttctgaaaatgcagaggtcagtgtgatggaatgaagtaggtgaagggttagtgaaaggtactctggaaattcagctacctccaaccttcatttatttagaaatatgaaaacatgtagaaatgtaaaatgtgaaaatgtaatggaaatgtggtaggagatacatgttttacatgaaatctttatatttttctgtaagcttgtttcataaatttttaaaaagaagtgattattctattaacaaatcaaacaattatttgactagggctagaggagcataaaaaaatatgttaactaaaaaccatcacagaggaaataactacaatgcaattatagctaatatttctatcattctaatttcagttgagagaaagaataaattctctttctgttttaaaagggaaaatttactagtgggaatcagttaattgcaaaattcacagaaagggctgaaaaaacagaatctaggcttgattctgaaattaccaaaaggttatttgttatttgtctttcataaccatgaatgtggcagtatgacgtcagagaaacagactcaacaggataggcaggtagatagacagatagatagacagacagacagacagacagatagatgatagatttattataaaatcttatggaggttgagcagccccaatacaacatatgtactcagcaagctgtagaatcaggagagctgatagtataagtttcaatccaaaagccagcacacttgacatccaaagagagctaatgtttctgtttgagtgtgaaagcaggaaaagaccaatatttcaactcaggcactcaggcagacgtttcctcttatagacagagggtcagtctttttgttctgtttaggttttcaactgagtggttgaggcctacccataattgagaggactatacgctttactcagtctaccaagtcaaatgttcatctcatcccataacaccctcatagacatacccagaaagtgtttgaccaaataatctgggcacctgtggcccagccaagttgacacataaaattgtctagcacagtggggaaccaggaaggtgctgttaaaacacttaaattcaataatgttaaaattgctgaaattggaagattgaatagcagctaccaataaaactgcctcttaaaacccatgctatttaaaaattatacacatctatctattcagacataaacttccacattaaaaccaattgcaacaagccatctactaatttaatgcaattattttcataaaagtaaaaacacattttttttcctcaaaagtttcaactacctgaaaaggaaagatcaaatatttcctttgtcattatctgtatctctggataatgcttatttattttctagttcactcatagtctcaccttaatgtcctatgcttcatctctgtttggaatctttacataatggggtgactcactcagaattttttttatgtcagtctcatttaagaatgttattgatgaagttaatacaatgtattaattttattaaatatttgttcttggatacacatcatttattattctgtgtgataaaatgggcagattgcataaaacagttctgctgaatactaaaatataatgttcatctgacataaaataatttgtaatggattgaattacaagctgaattatctacttttttcacagaatgaaaagttttacttgaaagaacgaccaaccaaatatagctattcatactctaaattatttgtcagatgtatgatttaaaaaatgaacaaagttaacatgtaacctcaaggacaaaaactgacagcaatttttgttaatgataaaatttcagtttttaagtgaaaattaaaattttgcaaaatgtggaaccaccattgtgaaggtgatgtcctctaacactaatatctcttctgatgagaatgttgtgaaattaaacaatgtgatttttaaattgttatattgagatatgtgaaatgtggaagttctgcactactcagtgaactgatattttccaaattggtaaaataagtatccaaaattcaaggtttaccaatagatattaaggtagtggtgtataaaccaattattggtatgatttcagttagtttccttgattgcaaataacgtttaagagactaccacgcattgagtttgagaatagtacctgagaagatatctataattatctgaaaatattattaaaatccttcctcttttgtgaacacatgtctctgtgagactgtttttgtcttcatatatttcaatcattaaattagatggcaatatatagatatattgatgtatatggcaaaatatattgagatatatatatatatatatatatatatatatatatatcaaactgaaaagtagtggcttaaacaagttagaagttaatttctctttcattaaaaattggttatgtagacaattgagagaattatataacagccccacaattgttaaagactgcatgtaccaggccaagcttatggtatagaactcatcatcactatgccccaatgtggaattccagctgttatattcctgttccaagcatcagcttgaagaaataaaggaaaaaacagcaaagcacacataccagctatcttttaagaaagtcagctaaatgctactacaggccacttgcacttgtatctcattacaaggatgtagtttcatgaccagccaaatcaaactgcaagggtgtttggagactatagatttcattctggatagtcatatactgacccaaatattctggaagttagtgatgatatgaagaaggattcaacttgcaggtttaagccctggttcttctcctaactggctgtataacctttgtcacattatttaagctttctaagccttagtttatttatttgtataatgggactatttacagtacctatctcataatgccattattatgataataatttgaaagaacttagaaaattatgtagcatattttattcagtgtacaacaaatgctaaaataaatacaattacatataaaaaacatgttttaagagtttaaaataggctgatattctaggagtgctacaagatgatttagatatataaaacctctgtcattcctcatacatcgtttttccttattgaaaagttggttaaaaacacattttaatgcttttgggaaagagagaaagagaaaagctccagctataatttgacagagaagggattgtaggaaacagacataactgatacagagtttttgttgtgggattgtaaggtataaaaataatttgttaattctcatagaatactcattatagtttatttttataattcaaaataaatcaaaccatattgaaaatcatctcagcctagtggaattagtagggaatcagcaatctagatcttggcattctatctccttaaaattttgattcacgacctatgtttgtgctgagctatgaacatgaggggttgatagacagatacagaatactgtgtgttgaggccatcagcagatccatcagtaagttccctcttcacagactagcaggttatagagctacagggttaaacagaataagctaacattgttaaagttcaaagatgaaaaaacaatcttttggaaggaggtgagcaagatacacttcatgaagaaactctaattacagtagtacattatgtataggatttagataaaagatacaaaagctttattctgaaaaaatcagaaaagtattatcaaaatcgtaagagtggacatattcagaatttgtctccaaaaaaattgacttgtggaatgatttgaagtaatacgatacagacatgagcttttaaattgtagatgtcttgtatgacaaactaaggatttatatatgccaattacaggtatcagaatgctgttgtaattttatgaacaagcaggttgcatgatggaagccatattttcagtgcatcattctaaagcagtatgaagcaggaaatggagggtaaagaaagaaaggctatggaggcaaagaataacaaagcctgatgtgaaaatggccaaaagttaaaagaatataaatttcaccttaactggtactagcagaaaagggtggagattctacccctttggagtaagagtctttcttgtcttttcaatgttctaatgatatatttggtggcaatatatcattggttttaaaaagactttcgaggtgatgctattatttatttatatttaaaaaattgtcagcccattcctctggacaagtaggtctagaatggacaccagaaatctgtactatgaccagatgatgtttttataccagccatgtttggaaactgcctaatcagattaatgtgaagtgttcttccacctcttaagtctaatttctgataaaatattatgtcactttaacaaatcataaatggcaaaatacattttcatttgttttaaaaagtgcattcactatgtcctaaagcaggggtccccaacccccaggctgcgaaacagtagcggtccgtggcctgttaggaaccgggccacacaatgggacatgagcagtgggcaaatgagctgagctctgcctactgtcagattagcagagccattagattttcataggagcaggaaccctattgtgaactgagcatgcaaggcaggtaggttgcccgctccttatgagaatctaatgcctgatgatgtgaagtgggacagtttcatccccaaaccacccatctgctaactctcacccgcctctgctccccattcgtgggaaaattgtcttccatgaaactggtctctggtgccaaaaaggttgggaacccctggccagaaggataaatctttaagtgcaataataccaagatgtggatctttgtaacttggctcatagatatatatcaacaaataattgtgattttaattgcaatatcataacataaaatttatttacagatagtcctaggggtacatcagataatctctctgccagagactatttctacataaaaattatataactgaaagattttcccacactgcttacatttaaataacattttgatttgagattcagcttttactaagaaagctagtattatttatctattttttttgcctcaaagtcttttctatttcttgattagactcacctaacatattatggtctgcatgacagtttaatcttgtcactgtctgtaattaagttataattagtttaaagatgaactttagtgaatctgtaaaacattcttatctgatcgacctattaattttgtcctttcttaggtcaagttgccactatttatgattaatttttgtgtaggcttagtctcacaaactaaatgtactattcataggtttgaataatttaatactcaacaatgtgaagataggttaaactgcatataaatttaggaaggacaatattgcttttgaaactaaaccttgaaaaatttgaaacttgaaaatattgtaatctttaatgtgatacgaataaacagcctttattcactaatgacagtttttagaccccaaagatgcaagagctgaacagcaacttcctgaggctattttatcattgtgtttggcaacattatgaccattgatattccgagagataatgtgtcatctgacaggacacagaacagcaagaacatttagtctgatgtgtatcagcaggatgaatatagtaatatttttattgtgaccatgtcacctacaatttgcaaatgactgtataaggaactttcctatttactgcctcctgcaataaactaaaatgaagaaaaattttaaagcctcactgaagttttattttaatatgttagttaaagaacaaggaaattatagtgcaaagataagacatggaaatcagcctggtaacatatttttaggatatccaacagagtgcaacagaatgagaaaacgttggataaatggaaatgtctgccgtttttgctgagatcacatgtatatatggctacagagaagataccactgagttatctttcaatgtaaaatctaaaattggtgataacaaatgctaaacacaaatttctttatgcagattaaaatataactaacagaaaataaaaacatctcaatttttattaactatcaaccaagtaatttaatttcataagggtcaacaaagccaaagactacaggcattacctactctacattctataataataaagtttttaatattctcttgattcactccacctacaaagacagtcttctgtgttctaaccttagtatgaacaaaatacttaattagtctataaatgataccaaacaaaggaaaagtggtcacaacaagtccctaagtgtttaattatcacgttggctgactaactcaagaagacatgaagtaacctattgaacttaattatacactgacctcatttaaagaaccatttctgtaagctgcttgctcaagcttatcctaattttatgtcctcacaaattctttcttgaagaattagtcctaaatagtttcatatagtaactatcatactattatcaggcatttcaaccatcttattgctgaataatacattaatcaaaatgcaataatgatttgtaaagaagcacattgctttcttaaactgtactgtatattaattgaaaagaaatacaccattggaccattcataagtgaattattttatttttgagacaggttctcactctctcattgtgatggttaatattgagttttaacttgattggattgaaggatgcaaagtactgattctgggtgtgtctgtgagggttttgccaaaggagatcaacatttgagtcagtggactgggaaaagcaaacccacccttactctgggtgggcacaacctaatcagctgccagcatgtccagaataaaaagtaggcagaacatgaaaaaactagacaggcctagcctcccagcctacatctttctcccatgctggatgcttcctgccctcacacatcgaactccaagttcttcagctttggtactcagactggcttccttgctcctcagcttgcaaatggccaattgtgggaccgtgtgatcgtgtgagttaataataaatatatttaatttatatatctcctattagttctgtccctctagagaaccctgatgaacaactcatccagggtggagtagagctcactgtaaccttctactcttgggctcaagtgatcctcctgcctcggcctcccaagtagctaggactacaggtgcatgcctgagtgaatgtttacgtggcattcgcaatattttaactgcaatatttctcaagtactgtgtcaaatattcagaaatacctactcttggaatttactctagaaaaatgcatcctaaaatattgttttaattctttctgatatgataaaacttattataagttaattctttccatacttttgatgtgtgctttctgtttaagtgtcttgaaatatttcatcattagattaaagaaaatatgttatacatttaccagtagaaaacatatcataataggcgattcttatcttactttacagtattctcattctgaattttttattatttgtgttttattatgtgtgtttctttcattagccttaaagaaattaccagtgaataataataacaatgatgctaggtaaataagggtattacggtagatcacaacaatagaatgctattcatatattaaaaaatacaaagaaaaaatgtatactttcaaaatagacatatttcaaagtgaggggtgttgactatggttaaggtttttatataataatatggacaataaattattgtaacttatttaaaaaatatagccatacctgcatctcctcgtacatacacacacagcatactcatcttcttttctatttaaatattttcagttgaatattcattcagaaaattcccttgacttacagaacagacatccttgacaaactgaaaaaaaagacaaagaaatatttcataccatacaaagacataaatattaaaatgtgctaacattttagaagcacacattaaaatgtcaaaataattctccaaagtagagcctttgtaaattaaatggaaaattattatccaagctacatacaagaaatgattgtccaagttttattcctcaaagtctccaaaaatattaggtacatgacagtaatagaaaagaaaaattatttcccccccaaagtcaagggaccataaaatactttagcagagtaataatcaattaaaaaatatcttacaaacaacagttaactcaaaagaagacagaatttttactgattttgtagtgggaccagtttttaaaattctactcttaattctctagaatttgggagaaacaaacacaagctcaatacaaccaataaaagaatgtcaagctctgaaatgtatttagaaatacagcgtttttcctacagcctctctgccttttttcatctttgttctctctagaattatcaatgagctcaggctaatgtatctatacattctcctgtatatatagacatattttatatacatatacacacaggcacataaagacattaaatacatataaatacattatacatacatatatgtgtgtttatttttttacaaaaacaaggcccttaatgttacatctatatataaataaaacaataatcacaatactttttactaatacaaatgaaatgcataatttgctcatataaatcaagacctttggattactattatctcatcattttcttggccttcttttataaatattggcttttattgtaataatttagaactttccgttctagtctattttggacgttttcttaacgtgcattatgtactgcataacatttgggttaaggatgaaccacatatacagccagtggtcccataagacaggggctcccaacccctaggccactgatgggtgctggtctatggcctgttaggactgggccgcatagtaggtggtgagtggcaggccaagtgagcattaccacctgagctctgcctcccgtcaaatcagcggcagcattagattcttttttttgtttttgagacagagtctcctctgtcgcccaggctggagtgtagtggcgtgatctcggctcactgcaagctccgcctcccgggttcacgccattctcctgcctcagcctcccgagtagctgggactacaggggcccaccaccatacctggctaattttttgtatttttagtagagacggggtttcaccgtgttagccaggatgatcttgatctcctgacctcgggatccgcccacctcggcctttccaagtgctgggattacaggcgtgaaccaccactgccggtcttttttttttttttttctgacaagagtcttgctctgtcgcctaggctggagtgcagtggcgcgatgtcggctcactgcaacctccgcctcccgggttcaagccattctcctacctcagcctctcaggtagctgggactataagcatgcgccaccacacccggctaagttttttgtattttcagtagagatggggcttcaccatgctggccaggctggtctcgaactcctgacctcaagtgatccacctgccttggcctcccaaagtgctgagattaaagacgtgagccactgcgcctggcctagagtctcataggtgcacaaaccctgttgtgaactgtgcatgcgaaggatccaggttgcctgctccatctaaggcttgatgatatgaggtggaagagtttcattctgaaaccattctccccaccacaccacaccagccccattcgtggaaaaattgtctttcacaaaaacgagtccctggcgctaaaaaggttggagacagttgccgtagattttaatggagatgaaaattcctatcagttagtgacatcagagccatcacagcaccctagtacaatgaattacttacatgtttgtggtgattctggtgtgagcaaacctactgtgctgctactttttaaaattataataaaaagtttaaaaagtgtattaaaatagaaaagagcttaaagaataaaaatataaagaaaaatattttatagtgctttaaaacgtgtgttaacctctgctgttacaaaacaatcaaaagtttaaaatttaaagagtttatacagtaaaaatgttacagtaaactaaggttaatttataattgaagaaaatgttttaaataaatttagtatagcctaaatgtacagcatttataaagtctacagtaatgtaccataatgtcctaggccttcacattcactcacaactcactcactgactcacccagagtaactttcagtcctgaaagtttcattcatggtaagtgccctataaaggtatacagttttttaaaatctttgataccatatttttactgtaccttttctatattaaagtgtgtttagaaatgcaaatattaacatttaccattgagttataattgcctacaacatttagtacgatgacatgctacaaaggtctctagcccaggagtaataggctataccatgtagcctaggtgtgtagtaggctacaccatctaggtttgtgtaagtacactttatgatgtttacacaatgatgaaatcacccaatgacacatttctcagaatgtatccctgtcattaagcagtacgtgactgtatgtttcttagttttcagaaaccttacttcccctttatattataaatttctactcacagtgtcatcttgcattttactacatattatgggaaaaattattatgcactatgattccttctcttcaccttttgtaacttgatatttctgctataactcacttttaatttcattatttaattttgttaagtattttccttaaaggaagttcatggatgttatgctttctaaattttgacatatgcatatatgtctgcaatttgtcatcacacatgagtgttgtcatggcaggtttagttttcttgtgtatccatcattttatttcagtagttatagttaattgtgttctggttttcaatgcaatctttacattttattaagatttcttatcatgctttatatattcatgtataatttaatatatattttaaatatccagctatataaaaattttctaaggacataacccaagatttgtgatttatttttatcacacatactatagctgaatcaaagataagagtcttactaagttggaataagaatacttaatttttgtagataatttttatcatttaaaagatactttaatgtttgtgcttatttattcttagttacatctttgagacctagagttctatcactatttaagagatgaaggaattaagtcttgtcaaattttaatgcagtattccaccactataatttcaaaacatgtaacacaggaaaatgtaacactaatgaaacttaccagtgaatataagttataaattattaaccagggacaagccaaatagctcttttgcttgatggcccagtgtatttaatttcatttataatatatacattgggatggttcatataaaactttaaatagtagtattcattaaaaaaagatatagccacaccgagtgtatattctcacaaataaaacacatgttttccatttgagcacaacctatacatggtcataacctgaacttcaaaacctgattttcctcctcttggatatttcagttgatgtcgaggcatctggattctattttgaaaactcctatacattaattaactaataaatatacaacatgcaaaatttcagggatatgaagatggaatacttccttttctagcccaagagtaaccaaaaaaattatttattgtatatttccattgttggaggacttctacagtctactgtgggatatacaatttttttaaggcacaattctatcttcttatgcttcacaatttatcaggcaagagagacacaaatgttaagtaaccacataataagttgacaatgagtaacactgagaaatgtgccactggtagattttaaatgttgagttattatgactattggaatatggtttcctcttaaagaaaaataatttcctcatatcaattctctgagaaatagttaatcctgaaacagaatttaatggtgtattaaattgagcaaaaaaacaaaattatcttctctacaggtctaagggaaggacttaaagagacaaaaatacttggctttgctttggtgtgtatgagcagctcctatgaagcagagacaaagcaagactgcacatatcatagagattctgttttttactagtaatgtgtataactgcagtggtgacattgtggagtggcttgcatttagagcaaaaatgtgcatgagtctcagatccactaataagtatacagccagcagaacttactgagaagagcaatgttttcacttgaggctgcagagagacaacagcaggtttagcaacaaagattgccgtgcccagtcaagtgatgacagcccaagatcagcattcacagaagaagcaggggtatgggatgatgaaaagattgtgacaaagtaacctaactgactagtaaatataagaaaaaacatgagacacttgagacattaactgctattaagaaggtaacaagtgctcatgattcaataactatgatataaaatcagggagtataatcacaatttgaaatcagaatcaggtaaaagttgagatatatggatcataatgttaataaaagagtggttgaaataaataatggagatattctaatgctataagtttttttttctaagagagaatgttaactgtcactgacatctgaaaatactttgaggaggagttgatatttaagcgaatcatggaaaaaaaatttctaatgtttggctgctgtgtgaggagtaagttcttcccagagaaaggaagccacttgagaaaagactgtgtgaaatacaagacattttgagaagaaagaatgacatgttggagcctaggtgatttgatgttccttttcactgtctttgagaaatgataaatgatgattccagtggcagtagtacacatgtgattatgtgtgtgaatctgtgtcatactagctgagcgtgtacttgatcctacatatagccatttatacttcatttcatgtatagatgaaataacaaggcagcctacattcctacagatacatgaattcctctagcattttcctacctgaataggtggtgtatatgtattgtgtttatgcatcatttttaccctaattttgaaatcactttctcttcaactttcctcaaattttaggtaattcatttttccttttctctttttttcaaaatgtcttgacttttctcttaagagaaaatttgctgaatcaaatttgttcaatgagtttaagcctatacagtacctttttgctaatctgatttttattttggtctgaaagacatttttaccgagttttggtttatcaacttggaaaaagtctatgggatattttattaaaaataattttattccaattgtcacatgacatttaatagctcgattcgaaagaactcgttattttaatacgatgttctacattaaaaacatttattaaatttaatgccacccaaaatatctggaatacaaatataaggtggatattcacttggaaagagttgggaaatgaaatgtagcgtcctcccagggtcttactcctgattaaacatgagtctgcctttggtaggaaagtcagccttgattttattccagataagcatgacaaaggcagtggtttgtttcagcctcaagtttctatggttttactaactctagccttgagaagcttcaggtaatgttgaagcttgtcaaatataaagattatcagaataggcagcaaggtagagagccgatgcaaagagttcatgtattgttatctagaggagaagatgatagtgcacgggagactgacttttaacactttaattcagaagtcagatagagtaacatatcattttgggagattttctgtgcattataggatacttgccactagggtcagagaagattgttatgtaaccacaatatgttttatattttatttttaacctttccacactacgtttctctgtagaaaagccttatagagctatagatagaaggaattaagttacacatagaaatttctttgctagagtaactgaaagggaaggaaaagaggtcaaccaataagatggaggaaagaaaaagagttcaaccaatgagagcagaggcaaatatccaagaggtcttgatcaatgggaattcatttttttcaacatatttgtatgtcagaaacttattaaaaattaacatttataaacatgtaaaacaaaaacaccttgtgtgtgttaaaaaatagggttgaaaagaataaacaaaataaatgatacaatgtaaaagcaactctaaaaatgctcaataggtctacagatagggcttcaaaaatacaaaaaataagttataattacagctctatcactatttgtccaacgagttggtacatttgataaataaaagattaagttactcatatgtttgaggggaagggtataaagtagaagttaggtgcaattgctttggagaaagaatgtctggtttaaaatcctggctccaatccgtactgttagccatgggactttgagaaacatctttcagttatcctaggcttagaggcattttcttgacctaccaggcttaatatgatctcatccctgccacctttctgatccattttcaccaatttatctaattcatgctgtattttcctaaagcatttcaaacaatttacctaaaacattccaaacaattaaggtatttgcactttgctgtcctcctagcctgaaatgctcttcctccagacatgctcataatgcactcctttcccttccttcacatctggacctgcagaggctcctgagagagactgattctggtcaccacataacaacatagcatctctctaccccaccacttcgatccttttattctgtttgacttgactttttcctctttggtatttatttccaacattttttcataaattccagatcctgcacaatattgccagcatcttagtatatatatttgtgtatgtatatgtatatatgttaatgagtgtatatcatttcctgtttattgcctgttggtctggttagaatgtaatctccatgaaaataggaactttaaccatttaattcatcaaccagaatacttgacacatggtacatgttgaatacacattttttgcaaaattaaatcaagtaatacaattcacacaatcaagcatgaattagtgaataaaggtactgctacatctcataattttataagtagagtacctgaaacattaaaaatgtttaataaatgttattactattgcatgcatcgtatttctctttttgctaatgtttataatgaagtaaaccacaattttaaataactattttattcagttttctgtcctagatattgctacatgtattggtacaaaatcaacacttggtctatgaaaatagctgtaccccgatccttattaatcatcctttcagtaaggtagaataaaaagagagactagttagccctccactgttctataaataaatagccctctgtatacattctttccttattgtgagacatttttgataagattaaatacacacatgaatattacttgatttttatgatccagataaaaaataaaacacttatttttatttagggtaaaacatctgtttctccttttcttatttgtcaatttttttctatacaggtcaacttaaccagaaagtcattatgggataaaacaaaatgttcttattttttaaaataaatagagtcataagcaagcagctgctgaactttctaagagtcacaacattaaagatggccaaatccattttcttcacaatattaggttaggattttttttttttttcaaaaaaaaggaagaacattcagtgaaaaaatatgtttagtttcataatatagttaccataatcttttacaaaagcatttttctttgttaatatgagatttaaaagtaataaaaatatacagaactcttttttatatctttgttttctatacatacccatatatgtatatatatcaagatgtatatacatattataagtggaatctaagtattttctgccaacattattttgatgtatatctaacatttattatgtttgatattgtccacttgttgaaaatgtgagcttgaaatcttgttttgagtttcttttttgtgttttcctttttattcttaatttgtttcttgttgttctgtttttatgtttctttcttctcctcatagtagtgcaataatattagtccattctttcactactataaagaaatacctgagacgggataatttataaaggaaagataatttatgaaggaaaatttattagctcatggttgcacaggatgtgcaagaagcatgacggcttctggggaggcatcaggaatctcgcagtcatggtggaaggcacaggggaagcagcacttcacatggctggagcacagggataggagagagccaggaagtaccacatgcttttaaagaagagatctcatgatagctcaccataatgagaacagcaccaaagggtaaatcctcccccgtgattcaatcatctcccaccaggccccatcttcaacatttgtgatatggttggctctgtgtccccacccaaatctcaccttgaattgtaatccccatagtcctcacaagtcaagggtgggacaggtaagggtaattgaatcgtggtggtggtttcccccatgctgttctcatggtcatgagtgagtctcacaagatctaatggttttataagcttctggcatttccactgctagcactcatgctctctcttgctgtcctgtgaagaggtgccttctgttatgactgtaagtttcctgaggtctccccagctatgcagaactgtgtcaattaaacctcttttttatagatgaagtttcactcttgttgcccaggctgcagtgcaatggcgcaatctcggctcactgcaacctccgcctcccaggttcaagctattctcctgcctcagcctcctgggtagctgggattacagaagcctgccactatgcccagctaatttgtttgtttgtttgtttgtatttttagtagagatgggtttccaccatgttggccaggctagtctccaactcctgacctcaggtgatctgcccacctcaacctcccaaaatgctgggattacaggcatgagccactgcacctggccattaaacctcttttctttataaattatctagtgtcaggtatttctttacagtagtgtgagaatggacttatacaatttgcaattacaatttgacatgagatttgggatggaccagaagcagaaagatatggcatggctctttgtccccatccaaatctcaccttgaattttaaaccccatagtccccatgtgtcaagagccagacctggtggaggtaattgaatcatgagatggtttcccccatgctgatctcatgataatgagtgagtctcacaagatctgatggttttataagcttctggcttttataagcttctgctgctagcactcgttctctctcctgctgtcctgtgaaaaagtgtcttctgctatgattgtaagtttcctgaggcctcccaagctatacagaactgtgagtcaattaaacctcttttctttataaattatctagtatcaggtatttcttcacaatagtgtgagaacggactaatacaattcacgattacaatttgacataagatttgggcaaggacacagacccaaaccatataatacctttattgggttgtttgatttttttgactacttattttatttttttctctctaattttaccactactgctttgtgagtcataaaaacatttgctgcttcttagtagttaacttcactccaaaccataaaatgaccttgatcactcgaacactgtataactcctctgacatacatacaattttatctagcattttagatataactttcagtttacctcataaattagacaattttacataggccccacttatttatttttattgatatgttcatcaagttctttataatttactcttgcatctacaactctctttctggggttattctttacctgagatgatgtcttttgaacccctttgatgaatgtctgtaggtgataaactttttgtatgtgtttgttggtttttctgaaaatatctttattttgcccttttccacacaaaaaaaatagttttactagaaacacgacacttggaaaatattgttgcactgtctttgggcttctgtaacataaattgaatgatcgtgctgtttcctatgtaagaggagcaaagaagatgatgactatactgaaaggaatgtttttagatttggtggtaagaatctgagggactttaagtctgggaggagtggtcatttgatggatttgaggagatacaaaacaaacatgaatcacattatctcagaaaatggtgaagggaatattctacgaaatgacagtacagataccaaacaaagacaagtgttaacttgacattaatgattgtaattcaaagaaaggtcagtcagcagagtattgtgattttctacagcaacactttggtttttatatgcaaagaatgagaaggcaaattctggtttactccagtcttttgcaaggcaagtatggatgagatagaatcaaagattgaaggtgttaagactgtatgtaagggaatggtttgtatttgaaccattaaacgtgctctagataggtagcaattagaaacagattgaggccaataaatggatataaactagtggattcaatgggttaaagtttttaataggacgaaagcattcttgcaaagagatttctacagaaaatgatcaagaaggtcatgacgtattattaataaatggtttaagatagaaagcttagaaacaattttgtatctctcattatgatatcttcagtgcatcatgggagtagaatgctgagatggaggcaagaaaatggaccacaaagtgaagagattggggactaagatgccatggctcttcctcctggaatggatcatccacatgaatatggagataatactaatgtcattcatcataatctcttgcatgattttgaatatatttgttagaaacaatttaatgtatattacccactgaatcaaaatttgcatctgacttttctattagtcatacattcaaaaaccaaattctggtgcttaggtttgtgcctctgaaatatagtaaagatactccaaagctaatgtggttccagtttttatttagtgggttaagaagagcaaattccatttccaactatgttgctatctagcagcataaccttagccaaatcaaatgatcttccaaggtttcaggttttttgtaggtaaacacagtttaaaattaaagtttacttaaaatcatttttaaactgaaagtctttcgatttaattatttaatttattgcttgttaaagtaccattcgttggctttgctctctaagttcatataattacttttacttaagatgtcctccaccactaaacttttatatggctatatatttgtgtggtatctgtcaccatggtacctagatatccaaccaacataactgtgtaaaaatagaaggtatgtgggaagaaaaaaatgtcaatccccatttttctattcaaacaggtattagtgaggcataaagattgtatctaaagtttgtttttttgagcttactgcccatgtgattacagagttatttatgagaaaaaggacaaaattcactatttatccaaatgtatgaacattcaatgtaatatttacatttgttaaataaagaaataaacctcccccttggtaatcattgcaaatatatatcccaaatgacaaataactatataaaaatgtaaaaactactacaaatgcacacaggcaataatgcagacgattacagtagtagaaaagtgacagctaaaatagactgctcataaagtttaccctttctgttgttattttttcaatgccactatttttaatcgctctgaagaagctaacaattttttttaatgtatggaaggaatataattaagacggaaataattggtaaggaataagtttagagataatgagctgctactaaataccaaagtagttggcagtctaatacaaatctggaaagattagaatcatagatacacaatttggagtcacaggtataaaaataatatttttaaagctgtgggactagatatcacttgcaacgtatcatagattgaggacaatgagaagggcctagaatgggttacagggtactccactctgcagaagtctagaaataaacatgcatcaacaagggagagtgagaagactctaccagtgaggaaagagaaacaagagtgtatggtactagaagccaatgaaaaaaacatgtgaagaagactatgatagaaaacgatattcagtgctattactataaacagggaaattatgttgtttagcaaaaaatgattaatcatgctgttgatatgattctgacataagctataattagtgaacccttgcatcttggtgttgtacatcatcacgtgagtatgtacacttgtcagatgtcttaggttcttttcagttaaacatggaataaaaccaactaaataaataattaatgagaaactgaaagagataacgaaatagaaagctagataaaaagagacgaaaaagtgtgactaatagaaacacaaactcataatataataaacaaaggaacatttaattttttaataaacctgagtaattgttctttaagttatcataaaatcttcatgtacatagataggccttgaaaaggagtcctgttttttctgctgtgttgagaagtaaactctagaattactctattaaagtatttaaaacttatgttttaaatatccaataaagcaagatctgggttttctcctcaatagatttatcatgaaattattgactaactacaggaattagagggaaggcattatgttctgactatagtcctgtctgactttgtattagtccattctcacactggtataaggacataccctagactgtataatttataaaagaaagaggtggaattgactcacagtttagcaaggctgggaaggcctcaggaaactttcaatcatggtggaaggggaagcaaacacatccttcttcacaaggcagcaggaagaagtgccaagtgaagtggtggaaaaactccttataaagccatcagatctcatgagaactcactcattatcatgagaacagcatggaggtaaccacctccatgattcaattacctcccaccaggtccctcccataacacttggggattatgggaactacagttcaagaatgagatttgggtggggacactgccaaaccacatcagactttatcatcttgcaggggaaaggggcgttactttccccttgagagcttaggatccccctcttatttgatgggggaattgactacataaatagtccccaacctttttggaatcaggggccagtttcatggaatacaatttttccatggatgggggtgcagtggatggtttctgaatgaagctgttccacttcagatcatcaggcattagattctcctaaggagcttgcaacctagatccctcacatgtgtagtttaaagtatggttcatgcccctacgagaatttaatgccaccagtgatctgaaaggaggtggagctcaagcagtaatgcaagccataggaagcagctataaacacagattaagcttcactcactcaccagccactcacctcctgctgtgtggcccagttcctaataggccatggactggtactggtccaatgcttagggattggggacccctgaactacatcatgattaaataaactttcatctatatgattctatagttttttttaacacagatgttacctgaaacctctaagcttttggagacaacattaggcttagctgtgcacattcaaattattttttaagatattcatgaatcttaaggcaaaaggcacatcagtgagattatatttttacatatgcttctgctttctagaattttatgtatctagggactattcttttatctgtgtaatgtgtcaaacaacgtggagatatattccctcttcatgattccaaataaaagaaaaaaaatgagaaaagaaagtaaaaaagggagagaggaagggagagagagagagagaaagaaagacaggaagaaagaaaggccacacaatgaataacttaatgatgagtgctgtaataaagcatatttaatatttgggacaagaaggagtcatcacaatgctaatgtgacaaatagacaagtagacaaataacattgtattcctgttcccaaagtacttttattcatttgccacccaggatttcccactgcctatgcccctcatattgcagctactgctggtcttgcatatcttggtgggtcaaaatcatatccccctctttccttttctttttcttggtttgccctgggaacttcaaatgttttctccatttattatgttcaacattttaagtatttttatctcataacaaatttgtctagcaaacacactaatgtattcaccacacaaaaggatatttcagttagcaagatcagccctccttgcaagatattatcagtcataaattgcccaacatatataaaattattattctaaatataaattatgtattatgaaattgggacccttgagcataaacagtagcagcagcaagcaaaatcatgggaagcactagtgataaaaaaaaaaatgctaggaaaaaaattttttgtctttgcaaacaggcaatatatgtatcttaggacccttaaaaatagagaaaaattaatattttatcattgtaatttcaaattaaaatttaaaaaattaaaataaaaaggcacattttttctcaaatattatactcttttaaaacaggtggttaaattagtataggtgtgagagagcaattatttccatataactatgaataaataaatttctatggaaattttacttttcatgatccttgcaaactaatctatttaaattattggtaaatatcttaataacaaaggcagctacatataaagaaaaaaataagactgtgccaaatgtttgaaatacctacaaggagattgcttttaataaacataaatagagaaattcaggatataccctttttgggttcaattttaagaaattactgttagccttatgtagttagttattacataatacttttttaaacgccttttgtcacggctatatgtaacaaaatataaaaatcagatgaaattaatgtatttagattttcccaatattatatgaaatataaatgttatgagaggtgggtagggaagtactgggacgggaagagtgtgatccctggctagtgctccacccccggggcttgtgcccatggacctaggtgaggacaggcatttctgttttcatgcccaaatgttgcatttcccaagaccaccttggcccactacatccccatcctgtgtctataaaataccctgagaccttaagtgggcacagacacaagtggctggacattgagaggaacacattggcctaacaccacactgacagtcaccagcagatgccagcaggccatcgaccaatggaatgacctggagtttggctgaggtggttggaggagagctaggccactaggcagcccaactccaggtgaaaactcccttcccattctatcccccttctggcctccccattcaccttgcggaaagctaccactcaataaaaaccttgcactcattctccaagcctatgtgtgatccgattcctgcagtacaccaaggcaagaaccgtgggatgcagaaagccctctgttcttatgataagaaagagggtctaatagagcttattaacacaagccacctacagacggctaaactaaaagagcaccctgtaacacatgcccactggggcttcaggaggtataaatacaaccccctagacactgccgccatgggtcagagccccacaacctgcctgtctgcatgctccccctagaggtttgggcagtggggcactgaagaagtgagctactcccctgtcacatgccctgcgagggggataagggaacttttcccacctcaactgaggactcatctgggatcccggaagtgagtgtgagcaaatgtgaaacttggctctgcgtctcttccaaaacctgctacctctgtttctctttcatgtgggtaagaggctctatttcccttcattaagtttttaacctccctaacctggccagtcaaaatccccagacttcgtcttttctctccctcacaatttgaaatggctcttatctcttcccttatatgttaagagttttgctacaggctgcggcaaagttactaagtaaaataagcatttggctcagcagacaaaggttcctagaggtgccatctgtgccttcatctcgatggccacaggcacacacggctcagggcacctctccttatcctttcgcctcccagcttgggtgcctgagcatgtccatggcaggcaaaggctgagccaagagggggcggggagagcagcgccatggccaccaactctgcctccactgcctgggacaagggggctggagaaaacaggcagtagccaggaccctacaggacacttctcgcccaccgtaccaatggaacctttcttgccctggccaaggaattaagcacagtgggaaccaggggaaagatacaaggattagagggacccacttgcactgagcaaaggcttctccccccattatctcccccttttgccccttaaactgttgttctcttgattccttttctaagtgaaaggctcaccctcttaactctgtttctgatatggaagctaatggaggaacgacctctgctggctgataactgcaaatttggcagggtttacaaacagcctctaaaataccttttcagtcccaaactcaatcccaagcctcaggctgaggccctataaagaaaaaccaggtctgagggatccaaagacaggcaataggcacaatgtaaatgggcaggaccaatttcctgcaagtaagtcccctgccccatgaaaggaggccatgcttcatggcataaacaggccactggacctcaaaggttgcagacagcaggaaaaagggaggcataggtgagagctgttaattcctgttctccagattttccctgtttcattggtacacactgcatcggtacctatgggtggtgcctgccaaggttgccaggacttggggtaaaagacgtggaagggaaagggaggacactcactttctctctccatcatacactgagtattcactaaaggaaggaatggaaagagggatgcctgtatcccttgtctttcagaatgggcaaccagctctcttcaccacccccagcttatacttctctggagtgtatcctgaaccattgggactgctttgatccttagaatctggaggaaaaatgcctcacagccctctacccaaaggtttggccaaattatcattcatagcaaggactggcttggtctcaggaaggaatgattcatttcaatacgatccagtagttgggctttttctgtagatgtgaggacagatggtctgaagccccatatgtgcaggctttctataccttgcaaggcaacccagacctctgccaacaatgtgggattgatccagccctcctgtttgtcgtctcagggaaggctgcaaggggcaagcccaggaaattaaagatacaaatcccagaggcactcccagcagaggagccagctccctcaagcccttctccctcctagaaatccttgccctcaacaagcctcagtctcgctcttgcccttccaacagatgcccaatgaatttgggcccagtaaggtccagggccccttctctgtacagtacttaaggcagatcaagggggatcttggcaagttttcacataactctgatagatagatagaggctgcagtatttcacccaaatatgtgaactctcctggagagatgttatgttaccctttcatcagaccctgacagacactgagaaacaggcaactctgcaagcagcagggagatctggggatgagctttgcatcacatacggcgtcaggaaagggagcacatattatttaactgggggagaagcagtacccgtgaaggacttaaatgggatcccaatgaccagatggaagactggaagaggagacactttcaggtgagcataacagaggacttatgtaagactaagaccaagcctctcaattatactaaggtgtccttgattgaccggggatttgacgaaaatcccattgccttcctggaaaggctgagggagcccttggtaaagcacacctttgcatctcctgattcagctgagggacagctaatcctaaaggatacatttattactcaggcagcccctgatatcaggaggaacttgcagaaacaggcccaccaaggcaagaaccctgggatacagaaagccttctgtccttgtgataaggcagagggcctaatagagcttagtaacacaagctaactacagatggctaaactaaaagaacaccctgtaacacacacccactggggcttcaggagttgtaaacacaccatcctagatgctgttgccatggggttgaagccctacaacctgcccatctgcatggtccccctggaggtttgagcagtggggcactgtagaggcgagccactccccctgtcacatgccctgcaagggggataaaggaacttttactgtttcattaagatctgaatctttagagtaagatcttaaattttaatcattccttgatttatgtaaattaaacctctctgaccacatagagacttttcaaaattctgtgttttgaagttttgtttttgtttttttgagttgctctgtcactcaggctggagtgcaatggagcgatcatggctcactgcagcccctacctcccaggatcaagagattctcccacttcagcctccagagtcactgggactaggtgctcaccaccatgcctagcaaatttgaaaatatttttgggggagacaagatctcactacattgcccaggctcttcttgctcaagcaatttttctgccttggcctcccaaagtgctaggattacaggcataaatcactgtgtctggcctaatatactgtttttgattgagagaagaggtttatgagagaagaataccatcatgaatgagagaagaaataccatcattgctcatgatggtattttggagtgatgctacttttaaaagtttatacctgacctggtgattatcgtagatatctcataagcatatgtaaatactaatacaaagatgattttatcaaataaactaaactaatgcattaaaaatccttaaaactaccataagaaaacgtggaatggaggattatatcctaaacatgataaaatgccatatgaagacaactaacaacttagtaataatagctatcacttgttatgcattaattggacatgccaagaacaagatgatttatacaaaaattcctacccgaatgaattatattaagtgattaatatagggcagggtccaagacagaccatgaggcaagcgtgtcagcttctcagcaccatttgtggagaaatgtgtgttgcattggcttacagctggttactgttaacttcctctgatttctaatattgaatttgatcagcagacagcctggttttgaccacataataagaggaattttaaaagattccctcctcagatgattgtgtgacttccctgagaccagcatatctcacagagttttcattatcaaaatataaagatgaagtacatcctgcatatttgagaaagaaacctgtgggctgcctgcttttggtctctcattactgtctcatattttaccttcattaaaactttacagaagtttaccctgtggagtttcataagcccttgtattgatctgatctgtgttgcaattctgagtagcaatatcattatgctccttttacaaatctgatcaagaacattgtcattttatggtctggagcaacaaaagagtgcccactatcaccactgcaattgaatcttgttctgaaacttacggtcagtgtgatcaaacaagaactagaaagaaaagatgcaagcattgcagttacttctgaaatcaaaattctataccagagaatttaaaagaatcaagtgagagaattcaaattttaaaattttaaaaaacgtcacatagtggcttgtgttgggggtctccaagaccattctcagggttgattattcgctggaatgactacaagattcaaaaagcagttacagtcatgatttcagttggttacagaaaaaggatagagattaaaatcatcaaaaggaaaggtacatgggacaaaacccagaagaatccagacacaggcttctggttgtcctctcttagtgtagtcaaatagacacagctaattataccagcaatgacgtgtgacaacacatgccaagtgtctccaatcaagaaagctcacccaagccttggtttctagggtgtttgttgcaaggtcagtcacataggcctgcagtaactatgtgtttttattagtattgtttttgaattagcaaatttctcttacaaaaacatcagatttttatagtggatttggaatattgttaaactatcaaacaagtgtttaaaatgtgagtcaaatacaaggaggaattacatttgattcatttcccaaatactttttcaagaaataggaacacttttacactgttggtgggactgtaaactagttcaacctttgtggaagtcagtgtggcgattcctcagggatctagaactagaaataccatttgacccagccatcccattactgggtatatacccaaaggaccataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggtggggaggggggagggatagcattgggagatatacctaatgctagatgacgagttagtgggtgcagtgcaccagcatggcatatgtatacatatgtaactaacctgcacaatgtgcacatgtaccctaaaacttaaagtataataaaaaaaaaaaaaagacatactgatagtattgtgcactgttctaggctgggattgttgtgaaaaacaaaacagatgtctgccattctcttgaaatatatattacgtctttccttttggtgaataaaggatcaatgttaatgtgaattgaaataactttatgattttacatatcaccatgtcaattatcctgtttgaaaacaagcagattggaactctacagcaatctgaacaaatcaaacatacatttactgagcagctagatatatacaaagtactatctccagggctgtgaatttatgtgcagtttacagccaagttaaatagcaaatgaatacatgacaaaataaaataaaatgtgacacactgtttcagatatcataagaaaggatatgacaataaatacattaataatatttattttttattcggtgcatggtacacaatgcataacattgtagatatttgaacaaccctacatgttagttttgatgatacttattttatatatacatatagaaagaagagaatgcaattattaccctaagacataaagataatacatatagcttggaattatacttattattctttattattattccctttaccccagtgccttttgaaatatttgtgatgaagaaatgcagatccatttgtggatcaatacttttgtaaagtgtaataaaaataaatatagtataaatacagtatatttaatataaaaataaatataaagtataataaaataaattaccagaaaattttcaaaaattaaattatgtaaaactcctcagctctaagagatccaaaatttaagaacacttactctaaagcttgtttatctgaatatttttccccttagaatgcttgtcctttatcgagagcctttagttaatataactgccacaaacactctaaggctaaggctgtattccatttaaaccgagtgtatgtgtgtgtgtgtgtgtgtgtgtgtgtgtgtgtgtgtatacatatataatcatgaaactctctctctctctctctctctctctatatatatatatatatatatatatatatagtttctatacttcagttggcaagagccagcaagaaagaaacatctattgaatttcttcctcatcatacttaacagtgaatgatactaaatgaaaattacttttatttcacttttactttatttcatttcacttttacaatggtaaaagtgtaaaaggaatagttgtctgaaactcttatattttctagttatattacactacgtttatcaattcatcaaataagatcctgtttcccttctgctaaccatccaataaggtttattgaaaaccacaagagttttatgcattcatttagaacatacggtcatgccttgcttaatgacgtggatacgttctgagaaatgtgttaggatatttcatcattatgtgaacatcacagagtgtactttcacaaatctagagggtatcaccttcttttctctttatttatttattttttttttgagacagagtctcactctgttgctcaggttggagtgcagtggcaggatctcggctccctgtgacttccacctcccagggtcaagcaattctcctgcctcagcctcctgagtagctgggattacagacgcccgccaccacacctggctaatttttgtatttttagtagagaagaggtttcaccatgttggccaggctgttctcaaactcctgacctcaggtgatctgcccacttccgcctctcgaaatgctgggattaaaggcatgagccactgtgcccggctgagggtaacactttctatacacctaggctatatggtatagcctattgctccttggctagaaagctgtagagcatgttgctgtacttaatactgtaggcaattctagcacaatggtaagtatctaaacatatgaaaacatggaaaagggacagtaaaaatacggtattgaaatcctagaggaccactgttggatatgcagtccattgctgactgaaactttgttatgaggcacatgactgtttattgagggcccttctaagcgccagtcataatctagtcagaaaacaagcaaaaagcaatattcttatggagcttacattaattatattcagataaactatgaatagcaagaataaatattttatataggatattaggtgacaattcctttgggtaaaattgggggaggaacagtggataaggcttgccaggggaggggaaaaggagaacagccacagtttcaaggaggacggtctgagctgaactcactgagagtgtgatgggaaggggaactggcaggtgtgaatgctctatggtgagggccagcgtgaaagagaattcagcgtgcctagcagaagggagtgatggggaggtagcagaagataaagtcagaaaggaaaggagagtgaaaagagtgggaatcattataaggactttcagttggacttctaagcaaaaaggggagctcctacatgagttttcattcccaaaggtacatcctgtgggttagaagggtagaagtattaagaccaatatggaggctattattctaatgaaaatgagagatgctaatgactcagcccagggggacagcagagaagagtggtcagattttgcatatactttgaaggaggaaccaacagatttcctgaaatattaaatgtgggatatgagagaaaacaattgatccaatatgactccagaattttcccttagcatcttgaaggaggaagttctcatcaaactgaagtagataaatcaggcttcagaggaaaagtgagaagttgagtttcggggttcagtagaacagtcttatatagggaccttggtttgaatgtcaacagcaggcagaagaaatgtaaaaccatgagactgaatgatcttacaaataatgtaagggggattttacaaatagggagaagactaagttcatatgcacatcaaattattttttgctacctaagaatcattaaaatggctctccctttgtgctttttgatttactgcaacttattaatgaactgtcttatttttgtcattctgagaactatgttaactaaaaagtggacatgtattatataataacacaagcttttcatctcattatgcatgcgtaagctttcagatagccattgtcaaaagactgtacactataaagcaaaacaatgtatttttaaatgttttaagacaaaactaatatttctttaaacattaaaactgtttgaccctatttcatgtcttatgaatgtagtagtagtttgatctaaaaataaaatgctaatctttcagggtttaattttcttgaagtactaagattttaaaaagtaagtaagattactatgctttagtcacacagctgtgatcctgtatatctttctctaacacagtgttacattattaaatcttgattctaggattattcagattttcaaaatgatagaaacaccccaaaatatggagaatacccacttgaatgccacagtcatgaggacagaaaattcttttcaccacatatgtaccccagacacacacaagatttcctggtacgtactagccattcaataaatattagaaagaaagaatgaataattaagattaccatctatctcagctgcatctcagtctgtgctaaaactacaatccgaaaatccatcattccattcacctaaatgggtatagaaaccaacatttttaattggtgatctatagcagtctttagcattggtaagaatttttttttttttttttttttttttttaagacagagtcttgctctgtcacccaggctggagtgcagtggcatgatctcggctcactcggctcactgcaagctccgcctcctgggtttatgccattctcctgcctcagactcctgactagctgggactacaggcgcccgccaccacgcccagctaatttctatttttagtagagacagggtttcaccatgataaccaggatggtctcaatttcctgcccttgtgatctgcccacctcagcctcccaaagtgctgggattacaggtgtgagccaccgtgcccggcctagcattggcaagaaatcttagccaatccctagtcaaaaaatcctgtgtgttagtcacaatggtcagagtgatgagattgaccaaaaaaaaaaaaaaaaaagtgaacagtcatatttaaagatatatattcttttaatgataaagagaacacatacaaaaaacttcagacatcaaatctggaagctttcagatgcaagtataagatttctggtttccgcaatccagcaccaactctcataaatagcttctctagttaaaactaatgtaaaagtcctaatggtagctaaacctcatttataatatacaagaaaaatgtcatatcagtaaaggaatatggtgattatgagaacctaatacaacatgcctaagtgaagaaagtaatagcaatatccataattcatcatcaaataaaaaggcacttgaaaacattgctcagtttgatctactggtacatttagtttgggggtgaatatacatatttatttatgataagcaattgaaatcatcaaactaatttctttgcgctaaattgtcatttttaaaattttgcactcacaaagaaaatgtctattacaatttttcttcctatgtgttttcctacaattagtaaaggagcttacagttgtcaattatatccaaatccacttgacatttaaatttatccttggcaattaataaattgtcatattttgtctttgaagaatttggagactactctgtttcctaggagccaaaaagcacaggttgctttgaaaagactgagtttctggagaagtcactctaccatggaaatttaccaggaagttgccatggatggtctatttccaggtacattcctcgccctatcttaaaatctgaattccatctaaactgtggggaaaattataggctgaaactactgagctctagatatgggaaactaagtcttcctcattatctaattattcccaacattgagttatccaggctctagtgatttaaactacctccatctgaaaaactcaaaaaggaactcacagtagagtcacctgtgatctcaagtgagttggacgactttggtaataatggatggagtaaggaagatgcagcaacatgtgataaattataaagcatgtgtgttttcggtatgaggaagaatttaatttgattcaattgcagtggagaccgaataaagattttataacaggagtggggacaatatgatgaatatttcagttgtctcttgctatataaccatccacagtttagtagcatacacattaatgacattattattatctcttgactctgtggattggttttgtctaaggtcactcttgtagctccattttagttggaatgtggcggtttaaacagtaagatccaaaattactcatatatttggcagttgtgctggctgcaagttggagaatctcagttcttttctactgggccactcagtttcctgcagcctagacacaaatagaaaacaagtctcaggttgcacagatggaagcaaaagccattattcctcttcaggcctatactctaaagtcatgctaatttactgttgtcacctttggttgttgaaagcaagttacaaggtaatctcagattcaagaagaagggaattagactctacctcttgatggaaaagggtgcaaagttgcattctaaagagacataagggatctgagagatttttgtgcaatcactgcaagtaatctgcaaaactttgttctgtggctaaaagattttacatctatttcatgtgcaaaatacatccaaaccctcacaaaatttcatcaaattacagcacaaagttcaggttctaagtccagaatcttattacctaatcctattctaatggtgatgtctcctaagatgtttttccttaggtgcagcttcctaggtagagctttttataagttagatacctgtgaactaaaaagatagtttaaaaacctttaatccactcagcagaccatattaagacaggaaggggattatcacagagaaaatcactcccattcattaaggaaatgaagaggaaaaggcaattatccgtcacaggtgatgaaat
